United States Patent
Devy

(10) Patent No.: US 8,013,125 B2
(45) Date of Patent: Sep. 6, 2011

(54) METALLOPROTEINASE 9 AND METALLOPROTEINASE 2 BINDING PROTEINS

(75) Inventor: Laetitia Devy, Somerville, MA (US)

(73) Assignee: Dyax Corp., Cambridge, MA (US)

( * ) Notice: Subject to any disclaimer, the term of this patent is extended or adjusted under 35 U.S.C. 154(b) by 226 days.

(21) Appl. No.: 12/397,285

(22) Filed: Mar. 3, 2009

(65) Prior Publication Data

US 2009/0297449 A1 Dec. 3, 2009

Related U.S. Application Data

(60) Provisional application No. 61/033,068, filed on Mar. 3, 2008.

(51) Int. Cl.
C12P 21/08 (2006.01)
(52) U.S. Cl. .................... 530/387.3; 530/391.7
(58) Field of Classification Search ............... 530/387.3, 530/391.7
See application file for complete search history.

(56) References Cited

U.S. PATENT DOCUMENTS

| | | | |
|---|---|---|---|
| 2002/0159971 A1 | 10/2002 | Houde et al. | |
| 2004/0115202 A1 | 6/2004 | Chen | |
| 2004/0146499 A1* | 7/2004 | Wood et al. | 424/94.65 |
| 2005/0118632 A1 | 6/2005 | Chen et al. | |
| 2006/0062777 A1 | 3/2006 | Brooks et al. | |
| 2006/0063204 A1 | 3/2006 | Valkirs et al. | |
| 2006/0142550 A1 | 6/2006 | Chang | |
| 2007/0203209 A1 | 8/2007 | Bartolini et al. | |
| 2007/0207184 A1 | 9/2007 | Ruane et al. | |
| 2007/0258987 A1 | 11/2007 | Francisco et al. | |
| 2008/0090821 A1 | 4/2008 | Hofmeister et al. | |
| 2008/0254490 A1 | 10/2008 | Menon | |
| 2009/0136524 A1 | 5/2009 | Takafuji et al. | |
| 2009/0186031 A1 | 7/2009 | Wood | |
| 2009/0203060 A1 | 8/2009 | Wood | |
| 2009/0209615 A1 | 8/2009 | Lipton et al. | |
| 2009/0297449 A1 | 12/2009 | Devy | |
| 2009/0311245 A1 | 12/2009 | Devy | |

FOREIGN PATENT DOCUMENTS

| | | |
|---|---|---|
| WO | 9957315 | 11/1999 |
| WO | 0190047 | 11/2001 |
| WO | 2009079581 | 6/2009 |
| WO | 2009079585 | 6/2009 |
| WO | 2009111450 | 9/2009 |
| WO | 2009111508 A2 | 9/2009 |
| WO | 2010045388 A2 | 4/2010 |
| WO | 2010048432 | 4/2010 |
| WO | 2011028883 A2 | 3/2011 |

OTHER PUBLICATIONS

Andrews et al., "Gelatinase B (MMP-9) is not essential in the normal kidney and does not influence progression of renal disease in a mouse model of Alport syndrome," Am. J. Pathol., Jul. 2000, vol. 157(1), pp. 303-311.

Buisson-Legendre et al., "Relationship Between Cell-Associated Matrix Metalloproteinase 9 and Psoriatic Keratinocyte Growth," Journal of Investigative Dermatology, 2000, vol. 115, pp. 213-218.
Collier et al., "On the structure and chromosome location of the 72- and 92-kDa human type IV collagenase genes," Genomics, 1991, vol. 9, pp. 429-434.
Coussens et al., "MMP-9 supplied by bone marrow-derived cells contributes to skin carcinogenesis," Cell, 2000, vol. 103, pp. 481-490.
Davis et al., "Matrix metalloproteinase-1 and -9 activation by plasmin regulates a novel endothelial cell-mediated mechanism of collagen gel contraction and capillary tube regression in three-dimensional collagen matrices," J. Cell. Sci., Mar. 2001, vol. 114(Pt. 5), pp. 917-30.
Di Carlo et al., "Urinary gelatinase activities (matrix metalloproteinases 2 and 9) in human bladder tumors," Oncol. Rep., 2006, vol. 15, pp. 1321-1326.
Dubois et al., Resistance of young gelatinase B-deficient mice to experimental autoimmune encephalomyelitis and necrotizing tail lesions, 1999, J. Clin. Invest. vol. 104, pp. 1507-1515.
Gijbels et al., "Gelatinase in the cerebrospinal fluid of patients with multiple sclerosis and other inflammatory neurological disorders," J. Neuroimmun. 1992, vol. 41, p. 29-34.
Gijbels et al., "Gelatinase B is present in the cerebrospinal fluid during experimental autoimmune encephalomyelitis and cleaves myelin basic protein," J. Neurosci. Res., 1993, vol. 36, pp. 432-440.
Gu et al., "S-nitrosylation of matrix metalloproteinases: signaling pathway to neuronal cell death," Science, 2002, vol. 297, pp. 1186-1190.
Gursoy-Ozdemir et al., Cortical spreading depression activates and upregulates MMP-9, J. Clin. Invest. 2004, vol. 113, pp. 1447-1455.
Graubert et al., "Cloning and Expression of the cDNA Encoding Mouse Neutrophil Gelatinase: Demonstration of Coordinate Secondary Granule Protein Gene Expression During Terminal Neutrophil Maturation," Blood, Nov. 15, 1993, vol. 82, No. 10, pp. 3192-3197.
Hayashidani et al., "Targeted deletion of MMP-2 attenuates early LV rupture and late remodeling after experimental myocardial infarction," 2003, Am. J. Physiol. Heart Circ. Physiol. vol. 285, pp. H1229-H1235.
Heymans et al., "Loss or inhibition of uPA or MMP-9 attenuates LV remodeling and dysfunction after acute pressure overload in mice," 2005, Am. J. Pathol., vol. 166, pp. 15-25.
Heymans et al., "Inhibition of plasminogen activators or matrix metalloproteinases prevents cardiac rupture but impairs therapeutic angiogenesis and causes cardiac failure," Nat. Med., 1999, vol. 5, pp. 1135-1142.
Heymans et al., "Inhibition of urokinase-type plasminogen activator or matrix metalloproteinases prevents cardiace injury and dysfunction during viral myocarditis," 2006, Circulation, vol. 114, pp. 565-573.
Heissig et al., Recruitment of stem and progenitor cells from the bone marrow niche requires MMP-9 mediated release of Kit-ligand, Cell, 2002, vol. 109, pp. 625-637.
Huhtala et al., Complete structure of the human gene for 92-kDa type IV collagenase: divergent regulation of expression for the 92- and 72-kilodalton enzyme genes in HT-1080 cells, J. Biol. Chem., 1991, vol. 266, pp. 16485-16490.

(Continued)

Primary Examiner — Misook Yu
Assistant Examiner — Brad Duffy
(74) Attorney, Agent, or Firm — Lando & Anastasi LLP

(57) ABSTRACT

Proteins that bind to matrix metalloproteinase 9 and to matrix metalloproteinase 2 and methods of using such proteins are described.

4 Claims, 8 Drawing Sheets

OTHER PUBLICATIONS

Hudson et al., "Effects of selective matrix metalloproteinase inhibitor (PG-116800) to prevent ventricular remodeling after myocardial infarction: results of the PREMIER (Prevention of Myocardial Infarction Early Remodeling) trial," J. Am. Coll. Cardiol., vol. 48, pp. 15-20.

Johnson et al., "Matrix metalloproteinase-2 and -9 differentially regulate smooth muscle cell migration and cell-mediated collagen organization," Arterioscler Thromb Vasc. Biol., 2004, vol. 24, pp. 54-60.

Kaliski et al., "Angiogenesis and tumor growth inhibition by a matrix metalloproteinase inhibitor targeting radiation-induced invasion," Mol. Cancer Ther., 2005, vol. 4, pp. 1717-1728.

Kawamura et al., "In situ gelatinolytic activity correlates with tumor progression and prognosis in patients with bladder cancer," J. Urol., 2004, vol. 172, pp. 1480-1484.

Kelly et al., Increased matrix metalloproteinase-9 in the airway after allergen challenge, 2000, Am. J. Resp. Crit. Care Med., 2000, vol. 162, pp. 1157-1161.

Kenagy et al., "Primate smooth muscle cell migration from aortic explants is mediated by endogenous platelet-derived growth factor and basic fibroblast growth factor acting through matrix metalloproteinases 2 and 9," Circulation, Nov. 18, 1997, vol. 96(10), pp. 355-3560.

Koivunen et al., "Tumor targeting with a selective gelantinase inhibitor," Nature Biotechnology, Aug. 1999, vol. 17, pp. 768-774.

Lambert et al., "MMP-2 and Mmp-9 synergize in promoting choroidal neovascularization," Faseb J., 2003, vol. 17, pp. 2290-2292.

La Rocca et al., "Zymographic detection and clinical correlations of MMP-2 and MMP-9 in breast cancer sera," Br. J. Cancer, 2004, vol. 90, pp. 1414-1421.

Larsen et al., "The expression of matrix metalloproteinase-12 by oligodendrocytes regulates their maturation and morphological differentiation," J. Neurosci., Sep. 1, 2004, vol. 24(35), pp. 7597-7603.

Laterveer et al., Rapid mobilization of hematopoietic progenitor cells in Rhesus monkeys by a single intravenous injection of interleukin-8, Blood, 1996, vol. 87, pp. 781-788.

Lee et al., "Matrix metalloproteinase-9 and spontaneous hemorrhage in an animal model of cerebral amyloid angiopathy," Ann. Neurol., 2003, vol. 54, pp. 379-382.

Linn et al., "Reassignment of the 92-kDa type IV collagenase gene (CLG4B) to human chromosome 20," Cytogent. Cell Genet., 1996, vol. 72, pp. 159-161.

Lin et al., "Salvianolic acid B attenuates MMP-2 and MMP-9 expression in vivo in apolipoprotein-E-deficient mouse aorta and in vitro in LPS-treated human aortic smooth muscle cells," J. Cell Biochem., 2007, vol. 100, pp. 372-384.

Masson et al., "Contribution of host MMP-2 and MMP-9 to promote tumor vascularization and invasion of malignant keratinocytes," Faseb J., 2005, vol. 19, pp. 234-236.

Matsuyama et al., "Matrix metalloproteinases as novel disease markers in Takayasu arteritis," Circulation, 2003, vol. 108, pp. 1469-1473.

Minematsu et al., Genetic polymorphism in matrix metalloproteinase-9 and pulmonary emphysema, Biochem. Biophys. Res. Commun., 2001, vol. 289, pp. 116-119.

NCBI Locus CAC07541, retrieved from http://www.ncbi.nlm.nih.gov/protein/9997653, retrieved May 14, 2009.

NCBI Locus NP_038627, retrieved from http://www.ncbi.nlm.nih.gov/protein/7305277, retrieved May 14, 2009.

Opdenakker et al., "The molecular basis of leukocytosis," Immun. Today, 1998, vol. 9, pp. 182-189.

Opdenakker et al., "Cytokine-mediated regulation of human leukocyte gelatinases and role in arthritis," Lymphokine Cytokine Res., 1991, vol. 10, pp. 317-324.

Osman et al., "Expression of matrix metalloproteinases and tissue inhibitors of metalloproteinases define the migratory characteristics of human monocyte-derived dendritic cells," Immunology, 2002, vol. 105, pp. 73-82.

Oulu University Library, Matrix metalloproteinases (MMPs) and their specific tissue inhibitors (TIMPs) in mature human odontoblasts and pulp tissue, 2003, http://herkules.oulu.fi/isbn9514270789/html/x561.html, retrieved on May 12, 2005, 9 pages.

Peterson et al., "Matrix metalloproteinase inhibition attenuates left ventricular remodeling and dysfunction in a rat model of progressive heart failure," 2001, Circulation, vol. 103, pp. 2303-2309.

Price et al., "Identification of a matrix-degrading phenotype in human tuberculosis in vitro and in vivo," J. Immun., 2001, vol. 166, pp. 4223-4230.

Pruijt et al., Prevention of interleukin-8-induced mobilization of hematopoietic progenitor cells in rhesus monkeys by inhibitory antibodies against the metalloproteinase gelatinase B (MMP-9), Proc. Nat. Acad. Sci., 1999, vol. 96, pp. 10863-10868.

Ramos-Desimone et al., "Inhibition of Matrix Metalloproteinase 9 Activation by a Specific Monoclonal Antibody," Hybridoma, 1993, vol. 12, No. 4, pp. 349-363.

Romanic et al., "Matrix metalloproteinase expression increases after cerebral focal ischemia in rats: inhibition of matrix metalloproteinase-9 reduces infarct size," Stroke, May 1998, vol. 29(5), pp. 1020-1030.

Seftor et al., "Cooperative interactions of laminin 5 gamma2 chain, matrix metalloproteinase-2, and membrane type-1 matrix/metalloproteinase are required for mimicry of embryonic vasculogenesis by aggressive melanoma," Cancer Res., Sep. 1, 2001, vol. 61(17), pp. 6322-6327.

St. Jean et al., "Characterization of a dinucleotide repeat in the 92 kDa type IV collagenase gene (CLG4B), localization of CLG4B to chromosome 20 and the role of CLG4B in aortic aneurismal disease," Ann. Hum. Genet., 1995, vol. 59, pp. 17-24.

Turner et al., "Role of matrix metalloproteinase 9 in pituitary tumor behavior," J. Clin. Endocr. Metab., 2000, vol. 85, pp. 2931-2935.

Choi et al., "Expression of Matrix Metalloproteinases in the Muscle of Patients with Inflammatory Myopathies", Neurology, vol. 54, Issue 1, Jan. 2000.

Galvez et al., "Membrane Type 1-Matrix Metalloproteinase is Activated During Migration of Human Endothelial Cells and Modulates Endothelial Motility and Matrix Remodeling", The Journal of Biological Chemistry, vol. 276, 40:37491-37500, 2001.

Itoh, "MT1-MMP: A Key Regulator of Cell Migration in Tissue", IUBMB Life, 58(10):589-596, Oct. 2006.

Nagase et al., "Nomenclature and Glossary of the Matrix Metalloproteinases", Matrix, Supplemental No. 1:421-424, 1992.

Paquette et al., "In Vitro Irradiation of Basement Membrane Enhances the Invasiveness of Breast Cancer Cells", British Journal of Cancer, 97:1505-1512, 2007.

Shinoda et al., "A Novel Matrix Metalloproteinase Inhibitor, FYK-1388 Suppresses Tumor Growth, Metastasis and Angiogenesis by Human Fibrosarcoma Cell Line", Int'l Journal of Oncology, 22:281-288, 2003.

International Search Report dated Mar. 10, 2011, from International Application No. PCT/US2010/47648.

Ueda et al., "Surviving gene expression in endometrosis," J. Clin. Endocr. Metab., 2002, vol. 87, pp. 3452-3459.

Vadillo-Ortega et al., "92-kd type IV collagenase (matrix metalloproteinase-9) activity in human amniochorion increases with labor," Am. J. Pathol., Jan. 1995, vol. 146(1), pp. 148-156.

Van Den Steen et al., "Neutrophil gelatinase B poteniates interleukin-8 tenfold by aminoterminal processing, whereas it degrades CTAP-III, PF-4, and GRO-alpha and leaves RANTES and MCP-2 intact," Blood, 2000, vol. 96, pp. 2673-2681.

Vu et al., "MMP-9/gelatinase B is a key regulator of growth plate angiogenesis and apoptosis o hypertrophic chondrocytes," Cell, 1998, vol. 93, pp. 411-422.

Wang et al., "Lipoprotein receptor-mediated induction of matrix metalloproteinase by tissue plasminogen activator," Nature Med., 2003, vol. 9, pp. 1313-1317.

Yan et al., "Repression of 92-kDa type IV collagenase expression by MTA1 is mediated through direct interactions with the promoter via a mechanism, which is both dependent on and independent of histone deacetylation," J. Biol. Chem., 2003, vol. 278, pp. 2309-2316.

Yu et al., "Cell surface-localized matrix metalloproteinase-9 proteolytically activates TGF-beta and promotes tumor invasion and angiogenesis," Genes Dev., 2000, vol. 14, pp. 163-176.

Zhao et al., "Activation of pro-gelatinase B by endometase/matrilysin-2 promotes invasion of human prostate cancer cells," J. Biol. Chem., Apr. 25, 2003, vol. 278(17), pp. 15056-15064.

International Search Report and Written Opinion from corresponding International Application No. PCT/US09/35926, dated May 28, 2009.

* cited by examiner

| 539A-M0266-E02 (Fab) | hMMP-9 | hMMP-2 | mMMP-9 | mMMP-2 |
|---|---|---|---|---|
| Kiapp ([25µM]) (nM) | 0.45 | 0.7 | 2.1 | 4.1 |

FIGURE 7

| MMP tested | 539A-M0266-E02 |
|---|---|
| MMP-1 | No |
| MMP-7 | No |
| MMP-8 | No |
| MMP-10 | No |
| MMP-12 | No |

FIGURE 8

METALLOPROTEINASE 9 AND METALLOPROTEINASE 2 BINDING PROTEINS

CROSS REFERENCE TO RELATED APPLICATIONS

This application claims priority to U.S. Application Ser. No. 61/033,068, filed on Mar. 3, 2008. The disclosures of the prior application is considered part of (and is incorporated by reference in) the disclosure of this application.

BACKGROUND

Matrix Metalloproteinases (MMPs) are a family of zinc metalloendopeptidases secreted by cells or membrane bound/associated, and are responsible for much of the turnover of matrix components. The MMP family consists of at least 26 members, all of which share a common catalytic core with a zinc molecule in the active site.

SUMMARY

This disclosure relates, inter alia, to proteins that bind both MMP-9 and MMP-2, herein referred to as "MMP-9/MMP-2 binding proteins," and methods of identifying and using such proteins. These proteins include antibodies and antibody fragments (e.g., primate antibodies and Fabs, especially human antibodies and Fabs) that bind to MMP-9 (e.g., human MMP-9) and MMP-2 (e.g., human MMP-2). The MMP-9/MMP-2 binding proteins are capable of binding to MMP-9 or to MMP-2. For example, the binding protein binds to MMP-9 or to MMP-2, but does not bind to both MMP-9 and MMP-2 at the same time. The MMP-9/MMP-2 binding protein is capable of inhibiting MMP-9 or MMP-2. For example, the binding protein inhibits MMP-9 or MMP-2, but does not inhibit both MMP-9 and MMP-2 at the same time.

In some embodiments, these proteins include antibodies and antibody fragments (e.g., primate antibodies and Fabs, especially human antibodies and Fabs) that inhibit MMP-9 (e.g., human MMP-9) (e.g., inhibit the catalytic activity of MMP-9) and MMP-2 (e.g., human MMP-2) (e.g., inhibit the catalytic activity of MMP-2). The MMP-9/MMP-2 binding proteins can be used in the treatment of diseases, particularly human disease, such as cancer, inflammation, heart failure, septic shock, neuropathic pain, or macular degeneration, in which excess or inappropriate activity of MMP-9 and MMP-2 features. In many cases, the proteins have tolerable low or no toxicity.

In some aspects, the disclosure relates to proteins (e.g., antibodies, peptides and Kunitz domain proteins) that bind MMP-9 and MMP-2, in particular, proteins (e.g., antibodies (e.g., human antibodies), peptides and Kunitz domain proteins) that bind and inhibit MMP-9 and bind and inhibit MMP-2.

In one embodiment, the disclosure provides a human antibody that binds to human MMP-9 and to MMP-2, e.g., the antibody is capable of binding to human MMP-9 or to human MMP-2. In one embodiment, the human antibody is an inhibitor of the catalytic activity of MMP-9 and is an inhibitor of the catalytic activity of MMP-2, e.g., it can inhibit the catalytic activity of MMP-9 or MMP-2. The antibody can be, e.g., an IgG1, IgG2, IgG3, IgG4, Fab, Fab2', scFv, minibody, scFv::Fc fusion, Fab::HSA fusion, HSA::Fab fusion, Fab::HSA::Fab fusion, or other molecule that comprises the antigen combining site of one of the antibodies herein listed. In one embodiment, the antibody is used to guide a nano-particle or toxin to a cell expressing MMP-9 or MMP-2 on the cell surface. In one embodiment, the antibody causes effector functions (CDC or ADCC) to kill the cell which expresses MMP-9 and/or MMP-2.

In some embodiments, the VH and VL regions of the binding proteins (e.g., Fabs) can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construct.

In another embodiment, the binding protein comprises a Kunitz domain protein or modified version (e.g., HSA fusion) or peptide-based MMP-9/MMP-2 binding protein that can inhibit MMP-9 and MMP-2 activity.

In one aspect, the disclosure features a protein (e.g., an isolated protein) that binds to MMP-9 (e.g., human MMP-9) and MMP-2 (e.g., human MMP-2) and includes at least one immunoglobulin variable region. For example, the protein includes a heavy chain (HC) immunoglobulin variable domain sequence and a light chain (LC) immunoglobulin variable domain sequence. The protein is capable of binding to MMP-9 (e.g., human MMP-9). The protein is capable of binding to MMP-2 (e.g., human MMP-2). For example, the protein binds MMP-9 or MMP-2, it does not bind both MMP-9 and MMP-2 at the same time. In one embodiment, the protein binds to and inhibits MMP-9 (e.g., inhibits MMP-9 catalytic activity), e.g., of human MMP-9, or binds to and inhibits MMP-2 (e.g., inhibits MMP-2 catalytic activity), e.g., of human MMP-2.

In some embodiments, the protein binds to human MMP-9 specifically, and not to MMP-9 from another species (e.g., the protein does not bind to MMP-9 from another species with greater than background levels of binding). In some embodiments, the protein binds to human MMP-2 specifically, and not to MMP-2 from another species (e.g., the protein does not bind to MMP-2 from another species with greater than background levels of binding).

In some embodiments, the protein is capable of binding to human MMP-9 or human MMP-2 and also is capable of binding to MMP-9 or MMP-2 of a rodent species selected from the group consisting of *Mus musculus, Rattus norvegus*, and *Macaca fascicularis*. In some embodiments, the Ki,app for the rodent species MMP9 or MMP-2 is no more than 10-fold higher than the Ki,app for the human MMP9 or MMP-2.

In some embodiments, the protein binds MMP-9 and MMP-2 specifically, and not to any other matrix metalloproteinase (e.g., the protein does not bind to any other matrix metalloproteinase with greater than background levels of binding).

Such binding proteins can be conjugated to a drug (e.g., to form a MMP-9/MMP-2 binding protein-drug conjugate) and used therapeutically. This disclosure relates, in part, to MMP-9/MMP-2 binding protein-drug conjugates, the preparation of these conjugates, and uses thereof. The conjugates can be used, e.g., in the treatment of disorders, e.g., for the treatment of cancer, inflammation, heart failure, septic shock, neuropathic pain, or macular degeneration. Targeting (e.g., an killing) of the MMP-9 and/or MMP-2 expressing cells and/or tumors, e.g., with high affinity binding protein-drug conjugates can be a potent therapy in the treatment of diseases, e.g., cancer, inflammation, heart failure, septic shock, neuropathic pain, or macular degeneration.

The protein can include one or more of the following characteristics: (a) a human CDR or human framework region; (b) the HC immunoglobulin variable domain sequence comprises one or more (e.g., 1, 2, or 3) CDRs that are at least 85, 88, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 90, 91, 92, 93, 94, 95, 96, 97, 98, 99, or 100% identical to a CDR of a LC variable domain described herein; (d) the LC immunoglobulin variable domain sequence is at least 85, 88, 90, 91, 92, 93, 94, 95, 96, 97, 98, 99, or 100% identical to a LC variable domain described herein; (e) the HC immunoglobulin variable domain sequence is at least 85, 88, 90, 91, 92, 93, 94, 95, 96, 97, 98, 99, or 100% identical to a HC variable domain described herein; (f) the protein binds an epitope bound by a protein described herein, or an epitope that overlaps with such epitope; and (g) a primate CDR or primate framework region.

The protein can bind to MMP-9, e.g., human MMP-9, and MMP-2, e.g., human MMP-2 with a binding affinity of at least $10^5$, $10^6$, $10^7$, $10^8$, $10^9$, $10^{10}$ and $10^{11}$ $M^{-1}$. In one embodiment, the protein binds to MMP-9 and/or MMP-2 with a $K_{off}$ slower than $1\times10^{-3}$, $5\times10^{-4}$ $s^{-1}$, or $1\times10^{-4}$ $s^{-1}$. In one embodiment, the protein binds to MMP-9 and/or MMP-2 with a $K_{on}$ faster than $1\times10^2$, $1\times10^3$ or $5\times10^3$ $M^{-1}s^{-1}$. In one embodiment, the protein inhibits human MMP-9 activity and/or MMP-2, e.g., with a Ki of less than $10^{-5}$, $10^{-6}$, $10^{-7}$, $10^{-8}$, $10^{-9}$, and $10^{-10}$ M. The protein can have, for example, an IC50 of less than 100 nM, 10 nM or 1 nM. In some embodiments, the protein has an IC50 of about 1.8 nM. The affinity of the protein for MMP-9 and/or MMP-2 can be characterized by a $K_D$ of less than 100 nm, less than 10 nM, or about 3 nM (e.g., 3.1 nM), about 5 nM (e.g., 5 nM), about 6 nm (e.g., 5.9 nM), about 7 nM (e.g., 7.1 nM), or about 10 nM (e.g., 9.6 nM).

In some embodiments, the protein has a $K_D$<200 nM.

In some embodiments, the protein has a t1/2 of at least about 10 minutes (e.g., 11 minutes), at least about 20 minutes (e.g., 18 minutes), at least about 25 minutes (e.g., 25 minutes), at least about 35 minutes (e.g., 33 minutes), or at least about 60 minutes (e.g., 57 minutes).

In one embodiment, the protein binds the catalytic domain of human MMP-9, e.g., the protein contacts residues in or near the active site of MMP-9. In one embodiment, the protein binds the catalytic domain of human MMP-2, e.g., the protein contacts residues in or near the active site of MMP-2.

In some embodiments, the protein does not contact residues in or near the active site of MMP-9 but instead binds elsewhere on MMP-9 and causes a steric change in MMP-9 that affects (e.g., inhibits) its activity. In some embodiments, the protein does not contact residues in or near the active site of MMP-2 but instead binds elsewhere on MMP-2 and causes a steric change in MMP-2 that affects (e.g., inhibits) its activity.

In a preferred embodiment, the protein is a human antibody having the light and heavy chains of the antibody M0237-D02. In a preferred embodiment, the protein is a human antibody having a heavy chain comprising the heavy chain of M0237-D02. In a preferred embodiment, the protein is a human antibody having a light chain comprising the light chain of M0237-D02. In a preferred embodiment, the protein is a human antibody having one or more (e.g., 1, 2, or 3) heavy chain CDRs picked from the corresponding CDRs of the heavy chain of M0237-D02. In a preferred embodiment, the protein is a human antibody having one or more (e.g., 1, 2, or 3) light chain CDRs picked from the light chain of M0237-D02.

In a more preferred embodiment, the protein is a human antibody having the light and heavy chains of M0237-D02.

In one embodiment, the HC and LC variable domain sequences are components of the same polypeptide chain. In another, the HC and LC variable domain sequences are components of different polypeptide chains. For example, the protein is an IgG, e.g., IgG1, IgG2, IgG3, or IgG4. The protein can be a soluble Fab (sFab). In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions. In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions. In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In certain embodiments, the protein includes no sequences from mice or rabbits (e.g., is not a murine or rabbit antibody).

In one embodiment, the protein is capable of binding to tumor cells expressing MMP-9, e.g., to Colo205 (a human colorectal carcinoma cell line), or MCF-7 (a human breast adenocarcinoma cell line) cells.

In one embodiment, protein is physically associated with a nanoparticle, and can be used to guide a nanoparticle to a cell expressing MMP-9 and/or MMP-2 on the cell surface. In one embodiment, the protein causes effector cells (CDC or ADCC) to kill a cell which expresses MMP-9 and/or MMP-2.

In some aspects, the antibody disclosed herein inhibits human MMP-9 (hMMP-9), human MMP-2 (hMMP-2), mouse MMP-9 (mMMP-9), and mouse MMP-2 (mMMP-2). In some embodiments, inhibition of MMP-9 and MMP-2 from other species (e.g., rat and cynomolgus monkeys) is also seen. Inhibition of MMP-9 and MMP-2 relate to the observation that MMP-9 and MMP-2 are both found in the conditions to be treated. Having activity toward human and mouse enzymes relates to the need to test the active pharmaceutical ingredient in mice before treating human subjects. Thus, in some preferred embodiments of the invention, the binding protein (e.g., antibody) has an apparent $K_i$ for hMMP-9 less than 1 nM, an apparent $K_i$ for hMMP-2 less than 1 nM, an apparent $K_i$ for mMMP-9 less than 1 nM, and an apparent $K_i$ for mMMP-2 less than 1 nM.

In some embodiment, these measurements are for Fabs. Converting a Fab into an IgG can lower the apparent $K_i$ (i.e., increase the degree of inhibition). The affinity for human MMP-9 and MMP-2 are more important than are those for the mouse since the stronger the affinity, the more effective is the drug at any given dose level. Hence, a Fab that has an apparent $K_i$ for hMMP-9 less than 1 nM, an apparent $K_i$ for hMMP-2 less than 1 nM, an apparent $K_i$ for mMMP-9 less than 5 nM, and an apparent $K_i$ for mMMP-2 less than 5 nM is an acceptable embodiment. A Fab that has an apparent $K_i$ for hMMP-9 less than 0.1 nM, an apparent $K_i$ for hMMP-2 less than 0.1 nM, an apparent $K_i$ for mMMP-9 less than 1 nM, and an apparent $K_i$ for mMMP-2 less than 1 nM is a preferred embodiment. Additionally, a Fab that has an apparent $K_i$ for hMMP-9 less than 0.1 nM, an apparent $K_i$ for hMMP-2 less than 0.1 nM, an apparent $K_i$ for mMMP-9 less than 5 nM, and an apparent $K_i$ for mMMP-2 less than 5 nM is a preferred embodiment.

In some aspects, the disclosure features an antibody (e.g., human antibody) that binds and inhibits (e.g., inhibits the catalytic activity of) hMMP9 with an apparent Ki (Ki app) of <1 nM, hMMP2 with Ki app of <1 nM, mMMP9 with Ki app of <1 nM, and/or mMMP2 with Ki app of <1 nM. In some embodiments, the antibody binds and inhibits hMMP9 with Ki app of <1 nM, hMMP2 with Ki app of <1 nM, mMMP9 with Ki app of <1 nM, and mMMP2 with Ki app of <1 nM.

In some aspects, the disclosure features an antibody (e.g., human antibody) that binds and inhibits hMMP9 with Ki app of <0.1 nM, hMMP2 with Ki app of <0.1 nM, mMMP9 with Ki app of <1 nM, and/or mMMP2 with Ki app of <1 nM. In some embodiments, the antibody binds and inhibits hMMP9 with Ki app of <0.1 nM, hMMP2 with Ki app of <0.1 nM, mMMP9 with Ki app of <1 nM, and mMMP2 with Ki app of <1 nM.

In some aspects, the disclosure features an antibody (e.g., human antibody) that binds and inhibits hMMP9 with Ki app of <1 nM, hMMP2 with Ki app of <1 nM, mMMP9 with Ki app of <5 nM, and mMMP2 with Ki app of <5 nM. In some embodiments, the antibody binds and/or inhibits hMMP9 with Ki app of <1 nM, hMMP2 with Ki app of <1 nM, mMMP9 with Ki app of <5 nM, and mMMP2 with Ki app of <5 nM.

In some aspects, the disclosure features an isolated protein that is a human antibody or a humanized antibody that is capable of binding human MMP9 with Ki,app<1 nM or human MMP-2 with Ki,app<1 nM or mouse MMP9 with Ki,app<about 5 nM or mouse MMP2 with Ki,app<about 5 nM.

In some aspects, the disclosure features an isolated protein that is a human antibody or a humanized antibody that is capable of binding human MMP9 with Ki,app<1 nM or human MMP-2 with Ki,app<1 nM.

In some aspects, the disclosure features an antibody (e.g., human antibody) that binds and inhibits hMMP9 with Ki app<0.1 nM, hMMP2 with Ki app<0.1 nM, mMMP9 with Ki app<5 nM, and/or mMMP2 with Ki app<5 nM. In some embodiments, the antibody binds and inhibits hMMP9 with Ki app<0.1 nM, hMMP2 with Ki app<0.1 nM, mMMP9 with Ki app<5 nM, and mMMP2 with Ki app<5 nM.

In some aspects, the antibody disclosed herein inhibits human MMP-9 (hMMP-9) and human MMP-2 (hMMP-2), but does not inhibit mouse MMP-9 (mMMP-9), and/or mouse MMP-2 (mMMP-2) (e.g., the antibody inhibits mMMP-9 and/or mMMP-2 less effectively (e.g., 5-, 10-, 50-, 100-, or 1000-fold less or not at all, e.g., as compared to a negative control) than it inhibits hMMP-9 and/or hMMP-2.

In some aspects, the disclosure features an antibody (e.g., human antibody) that binds and inhibits (e.g., inhibits the catalytic activity of) hMMP9 with an apparent Ki (Ki app) of <1 nM and hMMP2 with Ki app of <1 nM, but does not inhibit mMMP9 and/or mMMP2.

In some aspects, the disclosure features an antibody (e.g., human antibody) that binds and inhibits hMMP9 with Ki app of <0.1 nM and hMMP2 with Ki app of <0.1 nM, but does not inhibit mMMP9 and/or mMMP2.

In some aspects, the disclosure features an antibody (e.g., human antibody) that binds and inhibits hMMP9 with Ki app of <1 nM and hMMP2 with Ki app of <1 nM, but does not inhibit mMMP9 and/or mMMP2.

In some aspects, the disclosure features an antibody (e.g., human antibody) that binds and inhibits hMMP9 with Ki app<0.1 nM and hMMP2 with Ki app<0.1 nM.

In another aspect, the disclosure features a MMP-9/MMP-2 binding protein that is a competitive inhibitor of MMP-9 and MMP-2. In some embodiments, the binding protein competes with an MMP-9 substrate and/or an MMP-2 substrate (e.g., collagen, fibronectin and elastin), e.g., binds to the same epitope as the substrate, e.g., and prevents substrate binding.

In some aspects, the disclosure features a method of inhibiting an interaction between MMP-9 and/or MMP-2 and a substrate (e.g., collagen, fibronectin or elastin). The method includes contacting an MMP-9/MMP-2 binding protein described herein with MMP-9 and/or MMP-2 (e.g., in vitro or in vivo), wherein the binding protein binds to MMP-9 and MMP-2 and thereby prevents the binding of a substrate to MMP-9 and/or MMP-2. In some embodiments, the binding protein binds to the same epitope on MMP-9 or MMP-2 as the substrate, e.g., the binding protein is a competitive inhibitor. In some embodiments, the binding protein does not bind the same epitope as the substrate but causes a steric change in MMP-9 or MMP-2 that decreases or inhibits the ability of the substrate to bind.

In one aspect, the disclosure features a MMP-9/MMP-2 binding protein-drug conjugate that includes a MMP-9/MMP-2 binding protein and a drug.

In one embodiment, the binding protein comprises at least one immunoglobulin variable region, and/or the protein binds to and/or inhibits MMP-9, e.g., inhibits MMP-9 catalytic activity and MMP-2, e.g., inhibits MMP-2 catalytic activity.

In one embodiment, the drug is a cytotoxic or cytostatic agent. The cytotoxic agent can be, e.g., selected from the group consisting of an auristatin, a DNA minor groove binding agent, a DNA minor groove alkylating agent, an enediyne, a lexitropsin, a duocarmycin, a taxane, a puromycin, a dolastatin, a podophyllotoxin, a baccatin derivative, a cryptophysin, a combretastatin, a maytansinoid, and a vinca alkaloid. In one embodiment, the cytotoxic agent is an auristatin and, e.g., the auristatin is selected from AFP, MMAF, MMAE, AEB, AEVB and auristatin E. In one embodiment, the auristatin is AFP or MMAF. In another embodiment, the cytotoxic agent is a maytansinoid and, e.g., the maytansinoid is selected from a maytansinol, maytansine, DM1, DM2, DM3 and DM4. In one embodiment, the maytansinoid is DM1. In another embodiment, the cytotoxic agent is selected from paclitaxel, docetaxel, CC-1065, SN-38, topotecan, morpholino-doxorubicin, rhizoxin, cyanomorpholino-doxorubicin, dolastatin-10, echinomycin, combretatstatin, calicheamicin, and netropsin. In one embodiment, the cytotoxin is an auristatin, a maytansinoid, or calicheamicin.

In one embodiment, the cytotoxic agent is an antitubulin agent and, e.g., the antitubulin agent is selected from AFP, MMAP, MMAE, AEB, AEVB, auristatin E, vincristine, vinblastine, vindesine, vinorelbine, VP-16, camptothecin, paclitaxel, docetaxel, epothilone A, epothilone B, nocodazole, colchicines, colcimid, estramustine, cemadotin, discodermolide, maytansinol, maytansine, DM1, DM2, DM3, DM4 and eleutherobin.

In one embodiment, the MMP-9/MMP-2 binding protein (e.g., antibody) is conjugated to the drug (e.g., cytotoxic agent) via a linker. In one embodiment, the linker is cleavable under intracellular conditions, e.g., the cleavable linker is a peptide linker cleavable by an intracellular protease. In one embodiment, the linker is a peptide linker, e.g., a dipeptide linker, e.g., a val-cit linker or a phe-lys linker. In one embodiment, the cleavable linker is hydrolyzable at a pH of less than 5.5, e.g., the hydrolyzable linker is a hydrazone linker. In another embodiment, the cleavable linker is a disulfide linker.

A binding protein described herein can be provided as a pharmaceutical composition, e.g., including a pharmaceutically acceptable carrier. The composition can be at least 10, 20, 30, 50, 75, 85, 90, 95, 98, 99, or 99.9% free of other protein species. In some embodiments, the binding protein can be produced under GMP (good manufacturing practices). In some embodiments, the binding protein is provided in pharmaceutically acceptable carriers, e.g., suitable buffers or excipients.

The dose of a binding protein (e.g., a pharmaceutical composition containing a binding protein described herein) is sufficient to block about 20%, about 30%, about 40%, about 50%, about 60%, about 70%, about 80%, about 85%, about 90%, about 95%, about 99%, or about 100% of the activity of MMP-9 in the patient, e.g., at the site of disease. Depending on the disease, this may require a dose, e.g., of between about 0.01 mg/Kg to about 100 mg/Kg, e.g., between about 0.1 and about 10 mg/Kg. For example, the dose can be a dose of about 0.1, about 1, about 3, about 6, or about 10 mg/Kg. For example, for an IgG having a molecular mass of 150,000 g/mole (2 binding sites), these doses correspond to approximately 18 nM, 180 nM, 540 nM, 1.08 microM, and 1.8 microM, respectively, of binding sites for a 5 L blood volume. Medicine being partly an art, the optimal dose will be established by clinical trials, but will most likely lie in this range.

In another aspect, the disclosure features a method of detecting an MMP-9 and/or MMP-2 in a sample, e.g., a sample from a patient (e.g., tissue biopsy or blood sample). The method includes: contacting the sample with an MMP-9/MMP-2 binding protein; and detecting an interaction between the protein and the MMP-9 or MMP-2, if present. In some embodiments, the protein includes a detectable label. An MMP-9/MMP-2 binding protein can be used to detect MMP-9 and/or MMP-2 in a subject. The method includes: administering an MMP-9/MMP-2 binding protein to a subject; and detecting the protein in the subject. In some embodiments, the protein further includes a detectable label. For example, the detecting comprises imaging the subject. For example, MMP-9 and MMP-2 activity can be a marker of joint pathogenesis and/or disease progression in subjects with, or suspected of having, arthritis.

In another aspect, the disclosure features a method of modulating MMP-9 and MMP-2 activity. The method includes: contacting MMP-9 and/or MMP-2 with an MMP-9/MMP-2 binding protein (e.g., in a human subject), thereby modulating MMP-9 and/or MMP-2 activity. In some embodiments, the binding protein inhibits MMP-9 activity (e.g., inhibits MMP-9 catalytic activity) and/or inhibits MMP-2 activity (e.g., inhibits MMP-2 catalytic activity).

In another aspect, the disclosure features a method of treating cancer (e.g., metastatic cancer) (e.g., in a subject that has cancer or is suspected of having cancer). The method includes: administering, to a subject, an MMP-9/MMP-2 binding protein in an amount sufficient to treat a cancer in the subject. For example, the cancer is head and neck cancer, oral cavity cancer, laryngeal cancer, chondrosarcoma, breast cancer (which may be estrogen receptor positive (ER+), estrogen receptor negative (ER−), Her2 positive (Her2+), Her2 negative (Her2−), or a combination thereof, e.g., ER+/Her2+, ER+/Her2−, ER−/Her2+, or ER−/Her2−), laryngeal cancer, bladder cancer, ovarian cancer, testicular carcinoma, melanoma, or a brain tumor (e.g., astrocytomas, glioblastomas, gliomas).

MMP-9/MMP-2 binding proteins can be useful for modulating metastatic activity in a subject (e.g., in a subject that has a metastatic cancer or is suspected of having a metastatic cancer). The protein can be administered, to the subject, in an amount effective to modulate metastatic activity. For example, the protein inhibits one or more of: tumor growth, tumor embolism, tumor mobility, tumor invasiveness, and cancer cell proliferation.

The methods disclosed herein relating to the treatment cancer (e.g., treating cancer and/or modulation of metastatic activity) can further include providing (e.g., administering) to the subject a second therapy that is an anti-cancer therapy, e.g., administration of a chemotherapeutic, e.g., an agent that antagonizes signaling through a VEGF pathway, e.g., bevacizumab (AVASTIN®). In one embodiment, the second therapy includes administering 5-FU, leucovorin, and/or irinotecan. In one embodiment, the second therapy includes administering a Tie1 inhibitor (e.g., an anti-Tie1 antibody). As another example, the second agent can be an anti-MMP14 binding protein (e.g., IgG or Fab, e.g., DX-2400, or a protein described in U.S. Pub. App. No. 2007-0217997). In one embodiment, the second therapy is an inhibitor of plasmin (e.g., a kunitz domain disclosed in U.S. Pat. No. 6,010,880, such as a protein or polypeptide comprising the amino acid sequence MHSFCAFKAETGPCRARFDRWFFNIF-TRQCEEFIYGGCEGNQNRFESLEECKKMCTRD (SEQ ID NO:1).

In another aspect, the disclosure features a method of treating heart failure (e.g., in a subject that has heart failure or is suspected of having heart failure). The method includes: administering, to a subject, an MMP-9/MMP-2 binding protein in an amount sufficient to treat heart failure in the subject. The method can further include providing to the subject a second therapy that is a heart failure therapy.

In another aspect, the disclosure features a method of treating septic shock (e.g., in a subject that has septic shock or is suspected of having septic shock). The method includes: administering, to a subject, an MMP-9/MMP-2 binding protein in an amount sufficient to treat septic shock in the subject. The method can further include providing to the subject a second therapy that is a therapy for septic shock.

In another aspect, the disclosure features a method of treating neuropathic pain (e.g., in a subject that has neuropathic pain or is suspected of having neuropathic pain). The method includes: administering, to a subject, an MMP-9/MMP-2 binding protein in an amount sufficient to treat neuropathic pain in the subject. The method can further include providing to the subject a second therapy that is a therapy for neuropathic pain.

In another aspect, the disclosure features a method of treating an ocular condition (e.g., macular degeneration) (e.g., in a subject that has an ocular condition or is suspected of having an ocular condition). The method includes: administering, to a subject, an MMP-9/MMP-2 binding protein in an amount sufficient to treat the ocular condition in the subject. In one embodiment, the method further includes administering a second agent an agent that antagonizes signaling through a VEGF pathway, e.g., bevacizumab or ranibizumab. In one embodiment where the second agent is a VEGF pathway inhibitor (e.g., bevacizumab or ranibizumab), the ocular condition is macular degeneration, e.g., age-related macular degeneration, such as wet age-related macular degeneration.

In another aspect, the disclosure features a method of treating an inflammatory disease (e.g., chronic obstructive pulmonary disease (COPD), asthma, rhinitis, inflammatory bowel disease, synovitis, rheumatoid arthritis) (e.g., in a subject that has an inflammatory disease or is suspected of having an inflammatory disease). The method includes: administering, to a subject, an MMP-9/MMP-2 binding protein in an amount sufficient to treat the inflammatory disease in the subject. The method can further include providing to the subject a second therapy that is an anti-inflammatory therapy. For example, particularly for rheumatoid arthritis, the second therapy comprises administering one or more of the following agents: aspirin, naproxen, ibuprofen, etodolac, cortisone (corticosteroids), antacids, sucralfate, proton-pump inhibitors, misoprostol, gold (e.g., gold salts, gold thioglucose, gold thiomalate, oral gold), methotrexate, sulfasalazine, D-penicillamine, azathioprine, cyclophosphamide, chlorambucil, cyclosporine, leflunomide, etanercept, infliximab, anakinra, adalimumab, and/or hydroxychloroquine.

Other exemplary therapeutic methods that include administering an MMP-9/MMP-2 binding protein are described below. An MMP-9/MMP-2 binding protein described herein can be administered in combination with one or more other MMP inhibitors, e.g., small molecule inhibitors, e.g., broad specificity inhibitors. In one embodiment, the small molecule inhibitors are one or more of neovastat, marimastat, BAY 12-9566, or prinomastat. In another embodiment, the one or more MMP inhibitors include another MMP-9 binding protein and/or another MMP-2 binding protein.

MMP-9/MMP-2 binding proteins are useful for targeted delivery of an agent to a subject (e.g., a subject who has or is suspected of having a tumor), e.g., to direct the agent to a tumor in the subject. For example, an MMP-9/MMP-2 binding protein that is coupled to an anti-tumor agent (such as a chemotherapeutic, toxin, drug, or a radionuclide (e.g., $^{131}$I, $^{90}$Y, $^{177}$Lu)) can be administered to a subject who has or is suspected of having a tumor.

In another aspect, the disclosure features a method of imaging a subject. The method includes administering an MMP-9/MMP-2 binding protein to the subject. In some embodiments, the protein is one that does not substantially inhibit MMP-9 and/or MMP-2 catalytic activity. The MMP-9/MMP-2 binding protein may include a detectable label (e.g., a radionuclide or an MRI-detectable label). In one embodiment, the subject has or is suspected of having a tumor. The method is useful for cancer diagnosis, intraoperative tumor detection, post-operative tumor detection, or monitoring tumor invasive activity.

In one aspect, the disclosure features the use of an MMP-9/MMP-2 binding protein described herein for the manufacture of a medicament for the treatment of a disorder described herein, e.g., cancer, inflammation, heart failure, septic shock, neuropathic pain, or macular degeneration.

The details of one or more embodiments of the invention are set forth in the accompanying drawings and the description below. Other features, objects, and advantages of the invention will be apparent from the description and drawings, and from the claims.

The contents of all cited references including literature references, issued patents, published or non-published patent applications cited throughout this application as well as those listed below are hereby expressly incorporated by reference in their entireties. In case of conflict, the present application, including any definitions herein, will control.

DESCRIPTION OF DRAWINGS

In FIG. 1A, the substrate is human MMP-9. In FIG. 1B, the substrate is mouse MMP-9.

FIG. 7 is a table showing Kiapp ([25 µM] (nM) of 539A-M0266-E02 against human MMP-9, human MMP-2, mouse MMP-9 and mouse MMP-2.

FIG. 8 is a table showing cross-reactivity data for 539A-M0266-E02 against human MMP-1, -7, -8, 10 and -12.

DETAILED DESCRIPTION

Figure 1A:
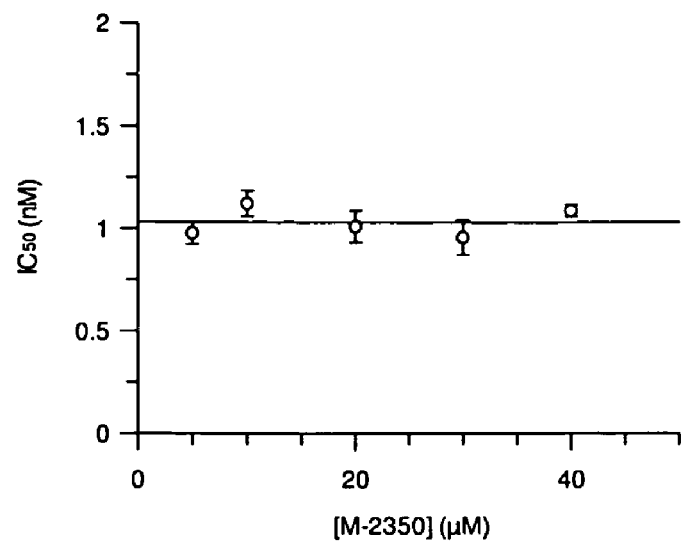
FIGS. 1A and 1B are two line graphs showing IC$_{50}$ (nM) versus substrate concentration (µM) of an MMP-9 binding protein (539A-M0237-D02).

Matrix metalloproteinase-2 (MMP-2) and matrix metalloproteinase-9 (MMP-9) are 72- and 92-kD, respectively, type IV collagenases that are members of a group of secreted zinc metalloproteases which, in mammals, degrade the collagens, fibronectin and elastin of the extracellular matrix. Other members of this group include interstitial collagenase (MMP-1) and stromelysin (MMP-3). MMP-2, the 72-kD type IV collagenase (also known as CLG4A), is secreted from normal skin fibroblasts, whereas MMP-9, the 92-kD collagenase (also known as CLG4B), is produced by normal alveolar macrophages and granulocytes. The present disclosure provides proteins that bind to MMP-9 and MMP-2 and, in some instances, inhibit MMP-9 and MMP-2 activity.

The term "binding protein" refers to a protein that can interact with a target molecule. This term is used interchangeably with "ligand." An "MMP-9/MMP-2 binding protein" refers to a protein that can interact with MMP-9 and MMP-2, and includes, in particular, proteins that preferentially interact with and/or inhibit MMP-9 and MMP-2. For example, the MMP-9/MMP-2 binding protein is an antibody.

The term "antibody" refers to a protein that includes at least one immunoglobulin variable domain or immunoglobulin variable domain sequence. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody" encompasses antigen-binding fragments of antibodies (e.g., single chain antibodies, Fab and sFab fragments, F(ab')$_2$, Fd fragments, Fv fragments, scFv, and domain antibodies (dAb) fragments (de Wildt et al., Eur J. Immunol. 1996; 26(3):629-39.)) as well as complete antibodies. An antibody can have the structural features of IgA, IgG, IgE, IgD, IgM (as well as subtypes thereof). Antibodies may be from any source, but primate (human and non-human primate) and primatized are preferred The VH and VL regions can be further subdivided into regions of hypervariability, termed "complementarity determining regions" ("CDR"), interspersed with regions that are more conserved, termed "framework regions" ("FR"). The extent of the framework region and CDRs has been precisely defined (see, Kabat, E. A., et al. (1991) *Sequences of Proteins of Immunological Interest, Fifth Edition*, U.S. Department of Health and Human Services, NIH Publication No. 91-3242, and Chothia, C. et al. (1987) J. Mol. Biol. 196:901-917. Kabat definitions are used herein. Each VH and VL is typically composed of three CDRs and four FRs, arranged from amino-terminus to carboxy-terminus in the following order: FR1, CDR1, FR2, CDR2, FR3, CDR3, FR4.

As used herein, an "immunoglobulin variable domain sequence" refers to an amino acid sequence which can form the structure of an immunoglobulin variable domain such that one or more CDR regions are positioned in a conformation suitable for an antigen binding site. For example, the sequence may include all or part of the amino acid sequence of a naturally-occurring variable domain. For example, the sequence may omit one, two or more N- or C-terminal amino acids, internal amino acids, may include one or more insertions or additional terminal amino acids, or may include other alterations. In one embodiment, a polypeptide that includes immunoglobulin variable domain sequence can associate with another immunoglobulin variable domain sequence to form an antigen binding site, e.g., a structure that preferentially interacts with an MMP-9 protein, e.g., the MMP-9 catalytic domain.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. In IgGs, the heavy chain constant region includes three immunoglobulin domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (Clq) of the classical complement system. The light chains of the immunoglobulin may be of types kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and LC CDR3. Each of the light chain CDRs can be human. HC CDR3 can be human. One or more of the framework regions can be human, e.g., FR1, FR2, FR3, and FR4 of the HC or LC. For example, the Fc region can be human. In one embodiment, all the framework regions are human, e.g., derived from a human somatic cell, e.g., a hematopoietic cell that produces immunoglobulins or a non-hematopoietic cell. In one embodiment, the human sequences are germline sequences, e.g., encoded by a germline nucleic acid. In one embodiment, the framework (FR) residues of a selected Fab can be converted to the amino-acid type of the corresponding residue in the most similar primate germline gene, especially the human germline gene. One or more of the constant regions can be human or effectively human. For example, at least 70, 75, 80, 85, 90, 91, 92, 93, 94, 95, 96, 97, 98, 99, or 100% of an immunoglobulin variable domain, the constant region, the constant domains (CH1, CH2, CH3, CL1), or the entire antibody can be human or effectively human.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the many immunoglobulin variable region genes. Full-length immunoglobulin "light chains" (about 25 KDa or about 214 amino acids) are encoded by a variable region gene at the NH2-terminus (about 110 amino acids) and a kappa or lambda constant region gene at the COOH—terminus. Full-length immunoglobulin "heavy chains" (about 50 KDa or about 446 amino acids), are similarly encoded by a variable region gene (about 116 amino acids) and one of the other aforementioned constant region genes, e.g., gamma (encoding about 330 amino acids). The length of human HC varies considerably because HC CDR3 varies from about 3 amino-acid residues to over 35 amino-acid residues.

The term "antigen-binding fragment" of a full length antibody refers to one or more fragments of a full-length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')$_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR) that retains functionality. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., U.S. Pat. Nos. 5,260,203, 4,946,778, and 4,881,175; Bird et al. (1988) *Science* 242:423-426; and Huston et al. (1988) *Proc. Natl. Acad. Sci. USA* 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refer to a preparation of antibodies or fragments thereof of single molecular composition, irrespective of how the antibody was generated.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human.

A "humanized" immunoglobulin variable region is an immunoglobulin variable region that is modified to include a sufficient number of human framework amino acid positions such that the immunoglobulin variable region does not elicit an immunogenic response in a normal human. Descriptions of "humanized" immunoglobulins include, for example, U.S. Pat. Nos. 6,407,213 and 5,693,762.

As used herein, "binding affinity" refers to the apparent association constant or $K_a$. The $K_a$ is the reciprocal of the dissociation constant ($K_d$). A binding protein may, for example, have a binding affinity of at least $10^5$, $10^6$, $10^7$, $10^8$, $10^9$, $10^{10}$ and $10^{11}$ M$^{-1}$ for a particular target molecule, e.g., MMP-9 and MMP-2. Higher affinity binding of a binding protein to a first target relative to a second target can be indicated by a higher $K_a$ (or a smaller numerical value $K_d$) for binding the first target than the $K_a$ (or numerical value $K_d$) for binding the second target. In such cases, the binding protein has specificity for the first target (e.g., a protein in a first conformation or mimic thereof) relative to the second target (e.g., the same protein in a second conformation or mimic thereof; or a second protein). Differences in binding affinity (e.g., for specificity or other comparisons) can be at least 1.5, 2, 3, 4, 5, 10, 15, 20, 37.5, 50, 70, 80, 91, 100, 500, 1000, or $10^5$ fold.

Binding affinity can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in TRIS-buffer (50 mM TRIS, 150 mM NaCl, 5 mM $CaCl_2$ at pH7.5). These techniques can be used to measure the concentration of bound and free binding protein as a function of binding protein (or target) concentration. The concentration of bound binding protein ([Bound]) is related to the concentration of free binding protein ([Free]) and the concentration of binding sites for the binding protein on the target where (N) is the number of binding sites per target molecule by the following equation:

$$[Bound] = N \cdot [Free]/((1/Ka) + [Free]).$$

It is not always necessary to make an exact determination of $K_a$, though, since sometimes it is sufficient to obtain a quantitative measurement of affinity, e.g., determined using a method such as ELISA or FACS analysis, is proportional to $K_a$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

The inhibition constant (Ki) provides a measure of inhibitor potency; it is the concentration of inhibitor required to reduce enzyme activity by half and is not dependent on enzyme or substrate concentrations. The apparent Ki (Ki app) is obtained at different substrate concentrations by measuring the inhibitory effect of different concentrations of inhibitor (e.g., inhibitory binding protein) on the extent of the reaction (e.g., enzyme activity); fitting the change in pseudo-first order rate constant as a function of inhibitor concentration to the Morrison equation (Equation 1) yields an estimate of the apparent Ki value. The Ki is obtained from the y-intercept extracted from a linear regression analysis of a plot of Ki,app versus substrate concentration.

$$v = v_o - v_o \left( \frac{(K_{i,app} + I + E) - \sqrt{(K_{i,app} + I + E)^2 - 4 \cdot I \cdot E}}{2 \cdot E} \right) \quad \text{Equation 1}$$

Where v=measured velocity; $v_0$=velocity in the absence of inhibitor; $K_{i,app}$=apparent inhibition constant; I=total inhibitor concentration; and E=total enzyme concentration.

An "isolated composition" refers to a composition (e.g., protein) that is removed from at least 90% of at least one component of a natural sample from which the isolated composition can be obtained. Compositions produced artificially or naturally can be "compositions of at least" a certain degree of purity if the species or population of species of interests is at least 5, 10, 25, 50, 75, 80, 90, 92, 95, 98, or 99% pure on a weight-weight basis.

An "epitope" refers to the site on a target compound that is bound by a binding protein (e.g., an antibody such as a Fab or full length antibody). In the case where the target compound is a protein, the site can be entirely composed of amino acid components, entirely composed of chemical modifications of amino acids of the protein (e.g., glycosyl moieties), or composed of combinations thereof. Overlapping epitopes include at least one common amino acid residue, glycosyl group, phosphate group, sulfate group, or other molecular feature.

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences.

In a preferred embodiment, the length of a reference sequence aligned for comparison purposes is at least 30%, preferably at least 40%, more preferably at least 50%, even more preferably at least 60%, and even more preferably at least 70%, 80%, 85%, 90%, 91%, 92%, 93%, 94%, 95%, 96%, 97%, 98%, 99%, or 100% of the length of the reference sequence. For example, the reference sequence may be the length of the immunoglobulin variable domain sequence.

As used herein, the term "substantially identical" (or "substantially homologous") is used herein to refer to a first amino acid or nucleic acid sequence that contains a sufficient number of identical or equivalent (e.g., with a similar side chain, e.g., conserved amino acid substitutions) amino acid residues or nucleotides to a second amino acid or nucleic acid sequence such that the first and second amino acid or nucleic acid sequences have (or encode proteins having) similar activities, e.g., a binding activity, a binding preference, or a biological activity. In the case of antibodies, the second antibody has the same specificity and has at least 50%, at least 25%, or at least 10% of the affinity relative to the same antigen.

Sequences similar or homologous (e.g., at least about 85% sequence identity) to the sequences disclosed herein are also part of this application. In some embodiments, the sequence identity can be about 85%, 90%, 91%, 92%, 93%, 94%, 95%, 96%, 97%, 98%, 99% or higher. In addition, substantial identity exists when the nucleic acid segments hybridize under selective hybridization conditions (e.g., highly stringent hybridization conditions), to the complement of the strand. The nucleic acids may be present in whole cells, in a cell lysate, or in a partially purified or substantially pure form.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6. Aqueous and nonaqueous methods are described in that reference and either can be used. Specific hybridization conditions referred to herein are as follows: (1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions in 6×SSC at about 45° C., followed by one or more washes in 0.2×SSC, 0.1% SDS at 60° C.; (3) high stringency hybridization conditions in 6×SSC at about 45° C., followed by one or more washes in 0.2×SSC, 0.1% SDS at 65° C.; and (4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified. The disclosure includes nucleic acids that hybridize with low, medium, high, or very high stringency to a nucleic acid described herein or to a complement thereof, e.g., nucleic acids encoding a binding protein described herein. The nucleic acids can be the same length or within 30, 20, or 10% of the length of the reference nucleic acid. The nucleic acid can correspond to a region encoding an immunoglobulin variable domain sequence described herein.

An MMP-9/MMP-2 binding protein may have mutations (e.g., at least one, two, or four, and/or less than 15, 10, 5, or 3) relative to a binding protein described herein (e.g., conservative or non-essential amino acid substitutions), which do not have a substantial effect on protein function. Whether or not a particular substitution will be tolerated, i.e., will not adversely affect biological properties, such as binding activity can be predicted, e.g., by evaluating whether the mutation is conservative or by the method of Bowie, et al. (1990) *Science* 247:1306-1310.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). It is possible for many framework and CDR amino acid residues to include one or more conservative substitutions.

Motif sequences for biopolymers can include positions which can be varied amino acids. For example, the symbol "X" in such a context generally refers to any amino acid (e.g., any of the twenty natural amino acids or any of the nineteen non-cysteine amino acids). Other allowed amino acids can also be indicated for example, using parentheses and slashes. For example, "(A/W/F/N/Q)" means that alanine, tryptophan, phenylalanine, asparagine, and glutamine are allowed at that particular position.

A "non-essential" amino acid residue is a residue that can be altered from the wild-type sequence of the binding agent, e.g., the antibody, without abolishing or more preferably, without substantially altering a biological activity, whereas changing an "essential" amino acid residue results in a substantial loss of activity.

The term "cognate ligand" refers to a naturally occurring ligand of an MMP-9 and/or MMP-2, including naturally occurring variants thereof (e.g., splice variants, naturally occurring mutants, and isoforms).

Statistical significance can be determined by any art known method. Exemplary statistical tests include: the Students t-test, Mann Whitney U non-parametric test, and Wilcoxon non-parametric statistical test. Some statistically significant relationships have a P value of less than 0.05 or 0.02. Particular binding proteins may show a difference, e.g., in specificity or binding, that are statistically significant (e.g., P value<0.05 or 0.02). The terms "induce", "inhibit", "potentiate", "elevate", "increase", "decrease" or the like, e.g., which denote distinguishable qualitative or quantitative differences between two states, and may refer to a difference, e.g., a statistically significant difference, between the two states.

MMP-9/MMP-2 Binding Proteins

The disclosure provides proteins that bind to MMP-9 (e.g., human MMP-9) and MMP-2 (e.g., human MMP-2) and include at least one immunoglobin variable region. For example, the MMP-9/MMP-2 binding protein includes a heavy chain (HC) immunoglobulin variable domain sequence and a light chain (LC) immunoglobulin variable domain sequence. An exemplary MMP-9/MMP-2 binding protein is described herein.

The MMP-9/MMP-2 binding protein may be an isolated protein (e.g., at least 70, 80, 85, 90, 91, 92, 93, 94, 95, 96, 97, 98, or 99% free of other proteins).

The MMP-9/MMP-2 binding protein may additionally inhibit MMP-9, e.g., human MMP-9 and/or MMP-2, e.g., human MMP-2. The binding protein can inhibit the catalytic activity of MMP-9 (e.g., human MMP-9) and/or MMP-2 (e.g., human MMP-2). In one embodiment, the protein binds the catalytic domain of human MMP-9, e.g., the protein contacts residues in or near the active site of MMP-9 and/or the protein binds the catalytic domain of human MMP-2, e.g., the protein contacts residues in or near the active site of MMP-2. In some embodiments, the protein does not contact residues in or near the active site of MMP-9 but instead binds elsewhere on MMP-9 and causes a steric change in MMP-9 that affects (e.g., inhibits) its activity. In other embodiments, the protein does not contact residues in or near the active site of MMP-2 but instead binds elsewhere on MMP-2 and causes a steric change in MMP-2 that affects (e.g., inhibits) its activity.

An exemplary MMP-9/MMP-2 binding protein is M0237-D02.

MMP-9/MMP-2 binding proteins may be antibodies. MMP-9/MMP-2 binding antibodies may have their HC and LC variable domain sequences included in a single polypeptide (e.g., scFv), or on different polypeptides (e.g., IgG or Fab).

Matrix Metalloproteinase 9 (MMP-9)

MMP-9 Sequences. MMP-9 is encoded by a gene designated as MMP9 with full name Matrix metalloproteinase-9 precursor. Synonyms for MMP-9 include matrix metalloproteinase 9, gelatinase B (GELB), 92 kDa gelatinase (CLG4B), 92 kDa type IV collagenase (EC 3.4.24.35). The DNA sequence is known for *Homo sapiens* and *Mus musculus*. An exemplary cDNA sequence encoding human MMP9 and the amino acid sequence are shown below. Exemplary cDNA sequences encoding murine MMP9 and amino acid sequences are also shown below. An exemplary MMP-9 protein can include the human or mouse MMP-9 amino acid sequence, a sequence that is 80%, 85%, 90%, 95%, 96%, 97%, 98%, or 99% identical to one of these sequences, or a fragment thereof, e.g., a fragment without the signal sequence or prodomain.

Table 1 shows the similar genes in other organisms and the percentage of similarity with human MMP-9. No similarity-to-human data found for MMP9 for: chimpanzee (*Pan troglodytes*), pig (*Sus scrofa*), cow (*Bos taurus*), fruit fly (*Drosophila melanogaster*), worm (*Caenorhabditis elegans*), baker's yeast (*Saccharomyces cerevisiae*), tropical clawed frog (*Silurana tropicalis*), African malaria mosquito (*Anopheles gambiae*), green algae (*Chlamydomonas reinhardtii*), soybean (*Glycine max*), barley (*Hordeum vulgare*), tomato (*Lycopersicon esculentum*), rice blast fungus (*Magnaporthe grisea*), sugarcane (*Saccharum officinarum*), loblolly pine (*Pinus taeda*), corn (*Zea mays*), wheat (*Triticum aestivum*), Alicante grape (*Vitis vinifera*), bread mold (*Neurospora crassa*), fission yeast (*Schizosaccharomyces pombe*), sea squirt (*Ciona intestinalis*), amoeba (*Dictyostelium discoideum*), *A. gosspyii* yeast (*Ashbya gossypii*), *K. lactis* yeast (*Kluyveromyces lactis*), medicago trunc (*Medicago truncatula*), malaria parasite (*Plasmodium falciparum*), schistosome parasite (*Schistosoma mansoni*), sorghum (*Sorghum bicolor*), toxoplasmosis (*Toxoplasma gondii*).

```
cDNA and amino acid sequences of human MMP9
ACCESSION AK123156
VERSION AK123156.1 GI:34528630 translation = "MARKGARRPRQGPGSHKWLQPGSRREKERIPQPPPPARPPRDAA
PRRVLVPAVRRVPESGHFAGRPWAPQCHPKGLRRPSAESHSVAQAGVQCHDLGSLQPP
PPSSGDSPASASRVAGITSTVPGTLSALDDCCLITELPYKPPAVLY"

1 acactttgcg ttccgcggcc ccggcccctt ggtttcctag tcctggctcc attccctct
  61 caggcctagg gctgggaccc ctccccgccc ccgtcttgg ccctgccccc ttcaacagac
 121 ggtccgcccc ggccctccc cctcgtcccg cccggccctg gcaggcccg cccctgcgg
 181 cctctacctt tgacgtcttc ccccgggagg tggcggggt ctgcgaccga atgccgcgg
 241 gactctgggt cagggcttct ggcgggccct gcggggggca gcgaggtgac cgtgaacctg
 301 cggctcatgg cgcggaaagg agccaggcgg ccgcggcaag gtccgggatc gcacaagtgg
 361 ctgcaaccag gctctaggag ggagaaagag cggatccccc aaccccctcc gcccgcccgc
 421 ccccgcgag acgcggcgcc gcgcagggtc ctagtgcccg ctgtgcgaag ggttcctgaa
 481 tctggccact tcgctgggag gccctgggct ccccagtgcc acccgaaggg cctgaggagg
 541 ccatctgcag aatctcactc tgtcgcccag gccggagtgc agtgtcatga tcttggctca
 601 ctgcaacctc cgcctcccag ttcaggagat tctcctgcct cagcctcccg ggtggctggg
 661 attacaagca cagtgcctgg cacattatcg gcacttgatg actgttgtct aataactgag
 721 cttccataca aaccacctgc cgtcctgtac tgaaggagaa agagcttcca gccggggagg
 781 caggaaatct gggtcctggt cttggttgca tccctgactt cctaaatgac ctggagaagg
 841 cctctgcctc tgctgggatc ttgtctgtgc tggggcattt gtttccattt ccaagggctt
 901 tttcttcctc gctcagaatt tgaccactca ctaagaggag cttagtgtgg tgtctcacga
 961 agggatcctc ctcagccctc acctcggtac tggaagacgt cgtgcgtgtc caaaggcacc
1021 ccggggaaca tccggtccac ctcgctggcg ctccggggat ccaccatctg cgccttcacg
1081 tcgaacctgc gggcaggcgc ggaggagaca ggtgctgagc cggctagcgg acggaccgac
1141 ggcgcccggg ctccccctgc cggcggccgc ggcggcgctc acctccagag gcgccgcccg
1201 ctgaacagca gcatcttccc cctgccactc cggagggccc cggtcacctg gccacgtcg
1261 gcgcccaggc ccagcttgtc cagacgcctc gggcccagca ccgacgcgcc tgtgtacacc
1321 cacacctggc gccctgcagg ggaggagggt cacgtcggtt tggggcgca gaggagcac
1381 gtactcctag aacgcgagga gggagattcc ggcgaggcct ttcctagccc gcgtgcccgc
1441 agtccctgca acccaggggc agaggcgctg ggtagagcga cgcgaggcg tggagaggag
1501 ggggcagaaa ctcagccgcc cctacgtttg ctaaactgcg tccgccaggg ggcgtatttt
1561 tctaaaacgc acaagacgtt tcgtgggtta tcgatggtct cttgagcctc cttgactgat
1621 ggggattgac cgggcggggg agggaaagta ggtaactaac cagagaagaa gaaaagcttc
```

```
1681 ttggagagcg gctcctcaaa gaccgagtcc agcttgcggg gcagcgcggg ccacttgtcg 1741 gcgataagga aggggccctg cggccggctc ccctgccct cagagaatcg ccagtacttc 1801 ctgagaaagc gaggagggaa aggacgggct ctaagccttg dacacagggc cagtgggcgg 1861 gaagggacgg gcagcccctc cgcaaagccc cctcccgcat ccacacaacc ccgcctcctc 1921 acccatcctt gaacaaatac agctggttcc caatc
``` cDNA and amno acid sequences of mouse MMP9
ACCESSION NM_013599
VERSION NM_013599.2 GI:31560795 translation = "MSPWQPLLLALLAFGCSSAAPYQRQPTFVVFPKDLKTSNLTDTQ
LAEAYLYRYGYTRAAQMMGEKQSLRPALLMLQKQLSLPQTGELDSQTLKAIRTPRCGV
PDVGRFQTFKGLKWDHHNITYWIQNYSEDLPRDMIDDAFARAFAVWGEVAPLTFTRVY
GPEADIVIQFGVAEHGDGYPFDGKDGLLAHAFPPGAGVQGDAHFDDDELWSLGKGVVI
PTYYGNSNGAPCHFPFTFEGRSYSACTTDGRNDGTPWCSTTADYDKDGKFGFCPSERL
YTEHGNGEGKPCVFPFIFEGRSYSACTTKGRSDGYRWCATTANYDQDKLYGFCPTRVD
ATVVGGNSAGELCVFPFVFLGKQYSSCTSDGRRDGRLWCATTSNFDTDKKWGFCPDQG
YSLFLVAAHEFGHALGLDHSSVPEALMYPLYSYLEGFPLNKDDIDGIQYLYGRGSKPD
PRPPATTTTEPQPTAPPTMCPTIPPTAYPTVGPTVGPTGAPSPGPTSSPSPGPTGAPS
PGPTAPPTAGSSEASTESLSPADNPCNVDVFDAIAEIQGALHFFKDGWYWKFLNHRGS
PLQGPFLTARTWPALPATLDSAFEDPQTKRVFFFSGRQMWVYTGKTVLGPRSLDKLGL
GPEVTHVSGLLPRRLGKALLFSKGRVWRFDLKSQKVDPQSVIRVDKEFSGVPWNSHDI
FQYQDKAYFCHGKFFWRVSFQNEVNKVDHEVNQVDDVGYVTYDLLQCP"

```
   1 ctcaccatga gtccctggca gcccctgctc ctggctctcc tggctttcgg ctgcagctct 61 gctgccctt accagcgcca gccgactttt gtggtcttcc ccaagacct gaaaacctcc 121 aacctcacgg acacccagct ggcagaggca tacttgtacc gctatggtta cacccgggcc 181 gcccagatga tgggagagaa gcagtctcta cggccggctt tgctgatgct tcagaagcag 241 ctctcctgc cccagactgg tgagctggac agccagacac taaaggccat cgaacacca 301 cgctgtggtg tcccagacgt gggtcgattc caaaccttca aaggcctcaa gtgggaccat 361 cataacatca catactggat ccaaaactac tctgaagact gccgcgaga catgatcgat 421 gacgccttcg cgcgcgcctt cgcggtgtgg ggcgaggtgg caccctcac cttcacccgc 481 gtgtacggac ccgaagcgga cattgtcatc cagtttggtg tcgcggagca cggagacggg 541 tatcccttcg acggcaagga cggccttctg gcacacgcct ttcccctgg cgccggcgtt 601 cagggagatg cccatttcga cgacgacgag ttgtggtcgc tgggcaaagg cgtcgtgatc 661 cccacttact atggaaactc aaatggtgcc ccatgtcact ttcccttcac cttcgaggga 721 cgctcctatt cggcctgcac cacagacggc cgcaacgacg gcacgccttg tgtagcaca 781 acagctgact acgataagga cggcaaattt ggtttctgcc ctagtgagag actctacacg 841 gagcacggca acggagaagg caaaccctgt gtgttcccgt tcatctttga gggccgctcc 901 tactctgcct gcaccactaa aggccgctcg gatggttacc gctggtgcgc caccacagcc 961 aactatgacc aggataaact gtatggcttc tgccctaccc gagtggacgc gaccgtagtt 1021 gggggcaact cggcaggaga gctgtgcgtc ttccccttcg tcttcctggg caagcagtac 1081 tcttcctgta ccagcgacgg ccgcagggat gggcgcctct ggtgtgcgac acatcgaac 1141 ttcgacactg acaagaagtg ggtttctgt ccagaccaag gtacagcct gttcctggtg 1201 gcagcgcacg agttcggcca tgcactgggc ttagatcatt ccagcgtgcc ggaagcgctc 1261 atgtaccccgc tgtatagcta cctcgagggc ttccctctga ataaagacga catagacggc 1321 atccagtatc tgtatggtcg tggctctaag cctgacccaa ggcctccagc caccaccaca 1381 actgaaccac agccgacagc acctcccact atgtgtccca ctataccctcc cacggcctat 1441 cccacagtgg gccccacggt tggccctaca ggcgccccct cacctggccc cacaagcagc 1501 ccgtcacctg gccctacagg cgcccccctca cctggcccta cagcgccccc tactgcgggc
```

-continued

```
1561 tcttctgagg cctctacaga gtctttgagt ccggcagaca atccttgcaa tgtggatgtt
1621 tttgatgcta ttgctgagat ccagggcgct ctgcatttct tcaaggacgg ttggtactgg
1681 aagttcctga atcatagagg aagcccatta cagggcccct tccttactgc ccgcacgtgg
1741 ccagccctgc ctgcaacgct ggactccgcc tttgaggatc cgcagaccaa gagggttttc
1801 ttcttctctg gacgtcaaat gtgggtgtac acaggcaaga ccgtgctggg ccccaggagt
1861 ctggataagt tgggtctagg cccagaggta acccacgtca gcgggcttct cccgcgtcgt
1921 ctcgggaagg ctctgctgtt cagcaagggg cgtgtctgga gattcgactt gaagtctcag
1981 aaggtggatc cccagagcgt cattcgcgtg gataaggagt tctctggtgt gccctggaac
2041 tcacacgaca tcttccagta ccaagacaaa gcctatttct gccatggcaa attcttctgg
2101 cgtgtgagtt ccaaaatgaa ggtgaacaag gtggaccatg aggtgaacca ggtggacgac
2161 gtgggctacg tgacctacga cctcctgcag tgcccttgaa ctagggctcc ttctttgctt
2221 caaccgtgca gtgcaagtct ctagagacca ccaccaccac caccacacac aaacccatc
2281 cgagggaaag gtgctagctg gccaggtaca gactggtgat ctcttctaga gactgggaag
2341 gagtggaggc aggcagggct ctctctgccc accgtccttt cttgttggac tgtttctaat
2401 aaacacggat ccccaacctt ttccagctac tttagtcaat cagcttatct gtagttgcag
2461 atgcatccga gcaagaagac aactttgtag ggtggattct gacctttat ttttgtgtgg
2521 cgtctgagaa ttgaatcagc tggcttttgt gacaggcact tcaccggcta aaccacctct
2581 cccgactcca gcccttttat ttattatgta tgaggttatg ttcacatgca tgtatttaac
2641 ccacagaatg cttactgtgt gtcgggcgcg gctccaaccg ctgcataaat attaaggtat
2701 tcagttgccc ctactggaag gtattatgta actatttctc tcttacattg gagaacacca
2761 ccgagctatc cactcatcaa acatttattg agagcatccc tagggagcca ggctctctac
2821 tgggcgttag ggacagaaat gttggttctt ccttcaagga ttgctcagag attctccgtg
2881 tcctgtaaat ctgctgaaac cagaccccag actcctctct ctcccgagag tccaactcac
2941 tcactgtggt tgctggcagc tgcagcatgc gtatacagca tgtgtgctag agaggtagag
3001 ggggtctgtg cgttatggtt caggtcagac tgtgtcctcc aggtgagatg accctcagc
3061 tggaactgat ccaggaagga taaccaagtg tcttcctggc agtctttttt aaataaatga
3121 ataaatgaat atttacttaa aaaaaaaaa aaaaaaaaa aaaaaaaaa aaaaaaaaa
3181 aaaaa
//
```

ACCESSION NP_038627
VERSION NP_038627.1 GI:7305277

```
  1 mspwqpllla llafgcssaa pyqrqptfvv fpkdlktsnl tdtqlaeayl yrygytraaq
 61 mmgekqslrp allmlqkqls lpqtgeldsq tlkairtprc gvpdvgrfqt fkglkwdhhn
121 itywiqnyse dlprdmidda farafavwge vapltftrvy gpeadiviqf gvaehgdgyp
181 fdgkdgllah afppgagvqg dahfdddelw slgkgvvipt yygnsngapc hfpftfegrs
241 ysacttdgrn dgtpwcstta dydkdgkfgf cpserlyteh gngegkpcvf pfifegrsys
301 acttkgrsdg yrwcattany dqdklygfcp trvdatvvgg nsagelcvfp fvflgkqyss
361 ctsdgrrdgr lwcattsnfd tdkkwgfcpd qgyslflvaa hefghalgld hssvpealmy
421 plysylegfp lnkddidgiq ylygrgskpd prppatttte pqptapptmc ptipptaypt
481 vgptvgptga pspgptssps pgptgapspg ptapptagss eastesispa dnpcnvdvfd
541 aiaeiqgalh ffkdgwywkf lnhrgsplqg pfltartwpa lpatldsafe dpqtkrvfff
```

```
601 sgrqmwvytg ktvlgprsld klglgpevth vsgllprrlg kallfskgrv wrfdlksqkv 661 dpqsvirvdk efsgvpwnsh difqyqdkay fchgkffwrv sfqnevnkvd hevnqvddvg 721 yvtydllqcp
//
```

TABLE 1

MMP-9 orthologs from nine species

| Organism | Gene | Locus | Description | Human Similarity | NCBI accessions |
|---|---|---|---|---|---|
| dog (*Canis familiaris*) | MMP9[1] | — | matrix metallopeptidase 9 (gelatinase B, 92 kDa gelatinase | 85.46(n) 80.97(a) | 403885 NM_001003219.1 NP_001003219.1 |
| rat (*Rattus norvegicus*) | Mmp9[1] | — | matrix metallopeptidase 9 | 79.15(n) 74.89(a) | 81687 NM_031055.1 NP_112317.1 |
| mouse (*Mus musculus*) | Mmp9[1,4] | 2 (96.00 cM)[4] | matrix metallopeptidase 9[1,4] | 78.69(n)[1] 75(a)[1] | 17395[1] NM_013599.2[1] NP_038627.1[1] AK004651[4] AK142787[4] (see all 16) |
| chicken (*Gallus gallus*) | LOC395387[1] | — | matrix metallopeptidase 9 (gelatinase B, 92 kDa gelatinase | 66.96(n) 62.54(a) | 395387 NM_204667.1 NP_989998.1 |
| zebrafish (*Danio rerio*) | wufb02g06[1-] | — | *Danio rerio* cDNA clone MGC64165 IMAGE6797338, complete | 70.96(n) | BC053292.1 |
| African clawed frog (*Xenopus laevis*) | MGC69080[1-] | — | hypothetical protein MGC69080 | 72.25(n) | BC057745.1 |
| rainbow trout (*Oncorhynchus mykiss*) | Omy.10476[1-] | — | *Oncorhynchus mykiss* mRNA for matrix metalloproteinase | 74.67(n) | AJ320533.1 |
| thale cress (*Arabidopsis thaliana*) | MMP[1] | — | MMP (MATRIX METALLOPROTEINASE); metalloendopeptidase/ | 53(n) 46.85(a) | 843353 NM_105685.3 NP_177174.1 |
| rice (*Oryza sativa*) | P0516G10.18[1] | — | putative zinc metalloproteinase | 51.98(n) 41.81(a) | 3063368 XM_467714.1 XP_467714.1 |

Domains of MMP-9. MMP-9 belongs to the peptidase M10A family. MMP-9 consists of five domains; the amino-terminal and zinc-binding domains shared by all members of the secreted metalloprotease gene family, the collagen-binding fibronectin-like domain also present in the 72-kDa type IV collagenase, a carboxyl-terminal hemopexin-like domain shared by all known enzymes of this family with the exception of PUMP-1, and a unique 54-amino-acid-long proline-rich domain homologous to the alpha 2 chain of type V collagen (Wilhelm et al. (1989) *J. Biol. Chem.* 264, 17213-17221) (Table 2).

TABLE 2

MMP-9 domains

| | | | |
|---|---|---|---|
| FT SIGNAL | 1 | 19 | |
| FT PROPEP | 20 | 93 | Activation peptide. |
| FT CHAIN | 94 | ? | 67 kDa matrix metalloproteinase-9. |
| FT CHAIN | 107 | 707 | 82 kDa matrix metalloproteinase-9. |
| FT PROPEP FT FT | ? | 707 | Removed in 64 kDa matrix metalloproteinase-9 and 67 kDa matrix metalloproteinase-9. |
| FT DOMAIN | 225 | 273 | Fibronectin type-II 1. |
| FT DOMAIN | 283 | 331 | Fibronectin type-II 2. |
| FT DOMAIN | 342 | 390 | Fibronectin type-II 3. |
| FT DOMAIN | 513 | 707 | Hemopexin-like. |
| FT ACT_SITE | 402 | 402 | |

TABLE 2-continued

MMP-9 domains

| | | | |
|---|---|---|---|
| FT METAL | 131 | 131 | Calcium 1. |
| FT METAL | 165 | 165 | Calcium 2 (via carbonyl oxygen). |
| FT METAL | 175 | 175 | Zinc 1 (structural). |
| FT METAL | 177 | 177 | Zinc 1 (structural). |
| FT METAL | 182 | 182 | Calcium 3. |
| FT METAL | 183 | 183 | Calcium 3 (via carbonyl oxygen). |
| FT METAL | 185 | 185 | Calcium 3 (via carbonyl oxygen). |
| FT METAL | 187 | 187 | Calcium 3 (via carbonyl oxygen). |
| FT METAL | 190 | 190 | Zinc 1 (structural). |
| FT METAL | 197 | 197 | Calcium 2 (via carbonyl oxygen). |
| FT METAL | 199 | 199 | Calcium 2 (via carbonyl oxygen). |
| FT METAL | 201 | 201 | Calcium 2. |
| FT METAL | 203 | 203 | Zinc 1 (structural). |
| FT METAL | 205 | 205 | Calcium 3. |
| FT METAL | 206 | 206 | Calcium 1. |
| FT METAL | 208 | 208 | Calcium 1. |
| FT METAL | 208 | 208 | Calcium 3. |
| FT METAL | 401 | 401 | Zinc 2 (catalytic). |
| FT METAL | 405 | 405 | Zinc 2 (catalytic). |
| FT METAL | 411 | 411 | Zinc 2 (catalytic). |
| FT SITE | 59 | 60 | Cleavage (by MMP3). |
| FT SITE | 99 | 99 | Cysteine switch (By similarity). |
| FT SITE | 106 | 107 | Cleavage (by MMP3). |
| FT CARBOHYD | 38 | 38 | N-linked (GlcNAc . . . ) (Potential). |
| FT CARBOHYD | 120 | 120 | N-linked (GlcNAc . . . ) (Potential). |
| FT CARBOHYD | 127 | 127 | N-linked (GlcNAc . . . ) (Potential). |
| FT DISULFID | 230 | 256 | By similarity. |
| FT DISULFID | 244 | 271 | By similarity. |

TABLE 2-continued

MMP-9 domains

| | | | |
|---|---|---|---|
| FT DISULFID | 288 | 314 | By similarity. |
| FT DISULFID | 302 | 329 | By similarity. |
| FT DISULFID | 347 | 373 | By similarity. |
| FT DISULFID | 361 | 388 | By similarity. |
| FT DISULFID | 516 | 704 | |
| FT VARIANT | 20 | 20 | A -> V (in dbSNP: rs1805088). |
| FT VARIANT | 82 | 82 | E -> K (in dbSNP: rs1805089). |
| FT VARIANT | 127 | 127 | N -> K (in dbSNP: rs3918252). |
| FT VARIANT | 239 | 239 | R -> H. |
| FT VARIANT | 279 | 279 | R -> Q (common polymorphism; dbSNP: rs17576). |
| FT VARIANT | 571 | 571 | F -> V. |
| FT VARIANT | 574 | 574 | P -> R (in dbSNP: rs2250889). |
| FT VARIANT | 668 | 668 | R -> Q (in dbSNP: rs17577). |
| FT TURN | 32 | 33 | |
| FT HELIX | 41 | 51 | |
| FT TURN | 52 | 53 | |
| FT HELIX | 68 | 78 | |
| FT TURN | 79 | 79 | |
| FT HELIX | 88 | 94 | |
| FT TURN | 95 | 95 | |
| FT STRAND | 103 | 105 | |
| FT STRAND | 119 | 125 | |
| FT STRAND | 130 | 132 | |
| FT HELIX | 134 | 149 | |
| FT TURN | 150 | 150 | |
| FT STRAND | 151 | 153 | |
| FT STRAND | 155 | 158 | |
| FT TURN | 162 | 163 | |
| FT STRAND | 164 | 171 | |
| FT STRAND | 176 | 178 | |
| FT STRAND | 183 | 186 | |
| FT STRAND | 189 | 191 | |
| FT STRAND | 194 | 196 | |
| FT TURN | 197 | 200 | |
| FT STRAND | 202 | 205 | |
| FT TURN | 206 | 207 | |
| FT STRAND | 213 | 219 | |
| FT HELIX | 220 | 231 | |
| FT TURN | 232 | 233 | |
| FT TURN | 240 | 241 | |
| FT TURN | 243 | 244 | |
| FT STRAND | 245 | 247 | |
| FT STRAND | 255 | 261 | |
| FT HELIX | 262 | 265 | |
| FT STRAND | 268 | 270 | |
| FT TURN | 274 | 276 | |
| FT STRAND | 279 | 283 | |
| FT TURN | 284 | 285 | |
| FT STRAND | 290 | 294 | |
| FT TURN | 295 | 296 | |
| FT STRAND | 297 | 301 | |
| FT TURN | 305 | 306 | |
| FT STRAND | 313 | 319 | |
| FT HELIX | 320 | 323 | |
| FT STRAND | 326 | 328 | |
| FT HELIX | 333 | 335 | |
| FT TURN | 340 | 344 | |
| FT STRAND | 349 | 353 | |
| FT TURN | 354 | 355 | |
| FT STRAND | 356 | 358 | |
| FT TURN | 364 | 365 | |
| FT STRAND | 372 | 378 | |
| FT HELIX | 379 | 382 | |
| FT STRAND | 385 | 387 | |
| FT HELIX | 395 | 406 | |
| FT TURN | 407 | 408 | |
| FT TURN | 415 | 416 | |
| FT TURN | 418 | 419 | |
| FT HELIX | 433 | 442 | |
| FT STRAND | 512 | 517 | |
| FT HELIX | 515 | 517 | |
| FT STRAND | 522 | 527 | |
| FT TURN | 528 | 529 | |
| FT STRAND | 530 | 535 | |
| FT TURN | 536 | 537 | |
| FT STRAND | 538 | 542 | |
| FT STRAND | 545 | 547 | |
| FT STRAND | 551 | 555 | |
| FT HELIX | 556 | 559 | |
| FT TURN | 561 | 562 | |
| FT STRAND | 568 | 572 | |
| FT TURN | 574 | 576 | |
| FT STRAND | 579 | 583 | |
| FT TURN | 584 | 585 | |
| FT STRAND | 586 | 591 | |
| FT TURN | 592 | 593 | |
| FT STRAND | 594 | 600 | |
| FT HELIX | 601 | 604 | |
| FT TURN | 605 | 605 | |
| FT TURN | 608 | 609 | |
| FT STRAND | 615 | 618 | |
| FT TURN | 621 | 622 | |
| FT STRAND | 623 | 628 | |
| FT TURN | 629 | 630 | |
| FT STRAND | 631 | 636 | |
| FT TURN | 637 | 640 | |
| FT HELIX | 644 | 646 | |
| FT HELIX | 650 | 653 | |
| FT TURN | 655 | 656 | |
| FT STRAND | 662 | 667 | |
| FT TURN | 668 | 669 | |
| FT STRAND | 670 | 675 | |
| FT TURN | 676 | 677 | |
| FT STRAND | 678 | 683 | |
| FT TURN | 686 | 687 | |
| FT STRAND | 690 | 696 | |
| FT TURN | 697 | 700 | |
| FT TURN | 702 | 703 | |

Factors that regulate MMP-9. The catalytic activity of MMP-9 is inhibited by histatin-3 1/24 (histatin-5). MMP-9 is activated by urokinase-type plasminogen activator; plasminogen; IL-1beta, 4-aminophenylmercuric acetate and phorbol ester. MMP-9 exists as monomer, disulfide-linked homodimer, and as a heterodimer with a 25 kDa protein. Macrophages and transformed cell lines produce only the monomeric MMP-9, the heterodimeric form is produced by normal alveolar macrophages and granulocytes. The processing of the precursor yields different active forms of 64, 67 and 82 kDa. Sequentially processing by MMP-3 yields the 82 kDa matrix metalloproteinase-9. In arthritis patients, this enzyme can contribute to the pathogenesis of joint destruction and can be a useful marker of disease status.

Endogenous inhibitors of MMP-9. MMP-9 has a number of endogenous inhibitors. Like other MMPs, MMP-9 is inhibited by TIMPs (Murphy, G., and Willenbrock, F. (1995) *Methods Enzymol.* 248, 496-510). A characteristic of MMP-9 (and MMP-2) is the ability of their zymogens to form tight non-covalent and stable complexes with TIMPs. It has been shown that pro-MMP-2 binds TIMP-2 (Goldberg et al. (1989) *Proc. Natl. Acad. Sci. U.S.A.* 86, 8207-8211), whereas pro-MMP-9 binds TIMP-1 (Wilhelm et al. (1989) *J. Biol. Chem.* 264, 17213-17221). TIMPs typically are slow, tight binding inhibitors. A MMP-9 binding protein (e.g., antibody) selected from a library of phage-displayed proteins can be selected have more rapid kinetics. For example, recombinant TIMP-1 can be administered to inhibit MMP-9, e.g., in combination with a MMP-9 binding protein described herein.

Small molecule inhibitors of MMP-9. Skiles et al. (2004, Curr Med Chem, 11:2911-77) reported that first generation small-molecule MMP inhibitors had poor bioavailability and the second generation had caused musculoskeletal pain and inflammation. Most small-molecule MMP inhibitors interact with the catalytic zinc but have fairly low affinity. Thus, a higher concentration is needed to have effect. The interaction with the catalytic zinc leads to inhibition of other MMPs and toxic side effects. A MMP-9 binding protein described herein can be used in combination with a small molecule inhibitor. For example, because the inhibitors are used in combination, the dose of the small molecule used can be decreased and therefore result in fewer side effects. Examples of small molecule MMP-9 inhibitors include small synthetic anthranilic acid-based inhibitors (see, e.g., Calbiochem Inhibitor-I, catalogue #444278 and Levin et al., 2001, *Bioorg. Med. Chem. Lett.* 11:2975-2978).

Small interfering RNA inhibitors of MMP-9. MMP-9 can be inhibited by small interfering RNA (siRNA). Examples of siRNA that can be used include:

```
MMP-9 siRNA
5'-GACUUGCCGCGAGACAUGAtt-3'

3'-ttCUGAACGGCGCUCUGUACU-5'

Control RNA (mismatch)
5'-GACUUCGCGGGACACAUGAtt-3'

3'-ttCUGAAGCGCCCUGUGUACU-5'
```

See also Kawasaki et al., Feb. 10, 2008, *Nat. Med.* advance on-line publication doi:10.1038/nm1723. The siRNA can be administered to inhibit MMP-9, e.g., in combination with a MMP-9 binding protein described herein.

Matrix Metalloproteinase 2 (MMP-2)

MMP-2 Sequences. MMP-2 is encoded by a gene designated as MMP2 with full name Matrix metalloproteinase-9 precursor. Synonyms for MMP-2 include matrix metalloproteinase 2, 72 kDa type IV collagenase precursor (72 kDa gelatinase), Gelatinase A, and TBE-1. The DNA sequence is known for *Homo sapiens* and *Mus musculus*. An exemplary cDNA sequence encoding human MMP2 and the amino acid sequence are shown below. Exemplary cDNA sequences encoding murine MMP2 and amino acid sequences are also shown below. An exemplary MMP-2 protein can include the human or mouse MMP-2 amino acid sequence, a sequence that is 80%, 85%, 90%, 95%, 96%, 97%, 98%, or 99% identical to one of these sequences, or a fragment thereof, e.g., a fragment without the signal sequence or prodomain.

```
cDNA and amino acid sequences of human MMP2
Accession BC002576.2
CTCAGGCGGTGGCTGGAGGCTGCGCATCTGGGGCTTTAAACATACAAAGG

GATTGCCAGGACCTGCGGCGGCGGCGGCGGCGGCGGGGGCTGGGGCGCGG

GGGCCGGACCATGAGCCGCTGAGCCGGGCAAACCCCAGGCCACCGAGCCA

GCGGACCCTCGGAGCGCAGCCCTGCGCCGCGGAGCAGGCTCCAACCAGGC

GGCGACGCGGCCACACGCACCGAGCCAGCGACCCCCGGGCGACGCGCGGG

GCCAGGGAGCGCTACGATGGAGGCGCTAATGGCCCGGGGCGCGCTCACGG

GTCCCCTGAGGGCGCTCTGTCTCCTGGGCTGCCTGCTGAGCCACGCCGCC

GCCGCGCCGTCGCCCATCATCAAGTTCCCCGGCGATGTCGCCCCCAAAAC

GGACAAAGAGTTGGCAGTGCAATACCTGAACACCTTCTATGGCTGCCCCA

AGGAGAGCTGCAACCTGTTTGTGCTGAAGGACACACTAAAGAAGATGCAG

AAGTTCTTTGGACTGCCCCAGACAGGTGATCTTGACCAGAATACCATCGA

GACCATGCGGAAGCCACGCTGCGGCAACCCAGATGTGGCCAACTACAACT

TCTTCCCTCGCAAGCCCAAGTGGGACAAGAACCAGATCACATACAGGATC

ATTGGCTACACACCTGATCTGGACCCAGAGACAGTGGATGATGCCTTTGC

TCGTGCCTTCCAAGTCTGGAGCGATGTGACCCCACTGCGGTTTTCTCGAA

TCCATGATGGAGAGGCAGACATCATGATCAACTTTGGCCGCTGGGAGCAT

GGCGATGGATACCCCTTTGACGGTAAGGACGGACTCCTGGCTCATGCCTT

CGCCCCAGGCACTGGTGTTGGGGGAGACTCCCATTTTGATGACGATGAGC

TATGGACCTTGGGAGAAGGCCAAGTGGTCCGTGTGAAGTATGGCAACGCC

GATGGGGAGTACTGCAAGTTCCCCCTTCTTGTTCAATGGCAAGGAGTACAA

CAGCTGCACTGATACCGGCCGCAGCGATGGCTTCCTCTGGTGCTCCACCA

CCTACAACTTTGAGAAGGATGGCAAGTACGGCTTCTGTCCCCATGAAGCC

CTGTTCACCATGGGCGGCAACGCTGAAGGACAGCCCTGCAAGTTTCCATT

CCGCTTCCAGGGCACATCCTATGACAGCTGCACCACTGAGGGCCGCACGG

ATGGCTACCGCTGGTGCGGCACCACTGAGGACTACGACCGCGACAAGAAG

TATGGCTTCTGCCCTGAGACCGCCATGTCCACTGTTGGTGGGAACTCAGA

AGGTGCCCCCTGTGTCTTCCCCTTCACTTTCCTGGGCAACAAATATGAGA

GCTGCACCAGCGCCGGCCGCAGTGACGGAAAGATGTGGTGTGCGACCACA

GCCAACTACGATGACGACCGCAAGTGGGGCTTCTGCCCTGACCAAGGGTA

CAGCCTGTTCCTCGTGGCAGCCCACGAGTTTGGCCACGCCATGGGGCTGG

AGCACTCCCAAGACCCTGGGGCCCTGATGGCACCCATTTACACCTACACC

AAGAACTTCCGTCTGTCCCAGGATGACATCAAGGGCATTCAGGAGCTCTA

TGGGGCCTCTCCTGACATTGACCTTGGCACCGGCCCCACCCCCACACTGG

GCCCTGTCACTCCTGAGATCTGCAAACAGGACATTGTATTTGATGGCATC

GCTCAGATCCGTGGTGAGATCTTCTTCTTCAAGGACCGGTTCATTTGGCG

GACTGTGACGCCACGTGACAAGCCCATGGGGCCCCTGCTGGTGGCCACAT

TCTGGCCTGAGCTCCCGGAAAAGATTGATGCGGTATACGAGGCCCCACAG

GAGGAGAAGGCTGTGTTCTTTGCAGGGAATGAATACTGGATCTACTCAGC

CAGCACCCTGGAGCGAGGGTACCCCAAGCCACTGACCAGCCTGGGACTGC

CCCCTGATGTCCAGCGAGTGGATGCCGCCTTTAACTGGAGCAAAAACAAG

AAGACATACATCTTTGCTGGAGACAAATTCTGGAGATACAATGAGGTGAA

GAAGAAAATGGATCCTGGCTTTCCCAAGCTCATCGCAGATGCCTGGAATG

CCATCCCCGATAACCTGGATGCCGTCGTGGACCTGCAGGGCGGCGGTCAC

AGCTACTTCTTCAAGGGTGCCTATTACCTGAAGCTGGAGAACCAAAGTCT

GAAGAGCGTGAAGTTTGGAAGCATCAAATCCGACTGGCTAGGCTGCTGAG

CTGGCCCTGGCTCCCACAGGCCCTTCCTCTCCACTGCCTTCGATACACCG

GGCCTGGAGAACTAGAGAAGGACCCGGAGGGGCCTGGCAGCCGTGCCTTC

AGCTCTACAGCTAATCAGCATTCTCACTCCTACCTGGTAATTTAAGATTC

CAGAGAGTGGCTCCTCCCGGTGCCCAAGAATAGATGCTGACTGTACTCCT

CCCAGGCGCCCTTCCCCCTCCAATCCCACCAACCCTCAGAGCCACCCCT

AAAGAGATCCTTTGATATTTTCAACGCAGCCCTGCTTTGGGCTGCCCTGG

TGCTGCCACACTTCAGGCTCTTCTCCTTTCACAACCTTCTGTGGCTCACA

GAACCCTTGGAGCCAATGGAGACTGTCTCAAGAGGGCACTGGTGGCCCGA

CAGCCTGGCACAGGGCAGTGGGACAGGGCATGGCCAGGTGGCCACTCCAG
```

-continued

ACCCCTGGCTTTTCACTGCTGGCTGCCTTAGAACCTTTCTTACATTAGCA

GTTTGCTTTGTATGCACTTTGTTTTTTCTTTGGGTCTTGTTTTTTTTTT

CCACTTAGAAATTGCATTTCCTGACAGAAGGACTCAGGTTGTCTGAAGTC

ACTGCACAGTGCATCTCAGCCCACATAGTGATGGTTCCCCTGTTCACTCT

ACTTAGCATGTCCCTACCGAGTCTCTTCTCCACTGGATGGAGGAAAACCA

AGCCGTGGCTTCCCGCTCAGCCCTCCCTGCCCCTCCCTTCAACCATTCCC

CATGGGAAATGTCAACAAGTATGAATAAAGACACCTACTGAGTGAAAAAA

AAAAAAAAAAAAAAA

/translation = "MEALMARGALTGPLRALCLLGCLLSHAAAPSPI
IKFPGDVAPKTDKELAVQYLNTFYGCPKESCNLFVLKDTLKKMQKFFGLP
QTGDLDQNTIETMRKPRCGNPDVANYNFFPRKPKWDKNQITYRIIGYTPD
LDPETVDDAFARAFQVWSDVTPLRFSRIHDGEADIMINFGRWEHGDGYPF
DGKDGLLAHAFAPGTGVGGDSHFDDDELWTLGEGQVVRVKYGNADGEYCK
FPFLFNGKEYNSCTDTGRSDGFLWCSTTYNFEKDGKYGFCPHEALFTMGG
NAEGQPCKFPFRFQGTSYDSCTTEGRTDGYRWCGTTEDYDRDKKYGFCPE
TAMSTVGGNSEGAPCVPPFTFLGNKYESCTSAGRSDGKMWCATTANYDDD
RKWGFCPDQGYSLFLVAAHEFGHAMGLEHSQDPGALMAPIYTYTKNFRLS
QDDIKGIQELYGASPDIDLGTGPTPTLGPVTPEICKQDIVFDGIAQIRGE
IFFFKDRFIWRTVTPRDKPMGPLLVATFWPELPEKIDAVYEAPQEEKAVF
FAGNEYWIYSASTLERGYPKPLTSLGLPPDVQRVDAAFNWSKNKKTYIFA
GDKFWRYNEVKKKMDPGFPKLIADAWNAIPDNLDAVVDLQGGGHSYFFKG
AYYLKLENQSLKSVKFGSIKSDWLGC"

cDNA and amno acid sequences of mouse MMP
Accession NM_008610.2
CCAGCCGGCCACATCTGGCGTCTGCCCGCCCTTGTTTCCGCTGCATCCAG

ACTTCCCTGGTGGCTGGAGGCTCTGTGTGCATCCAGGAGTTTAGATATAC

AAAGGGATTGCCAGGACCTGCAAGCACCCGCGGCAGTGGTGTGTATTGGG

ACGTGGGACCCCGTTATGAGCTCCTGAGCCCCGAGAAGCAGAGGCAGTAG

AGTAAGGGGATCGCCGTGCAGGGCAGGCGCCAGCCGGGCGGACCCCAGGG

CACAGCCAGAGACCTCAGGGTGACACGCGGAGCCCGGGAGCGCAACGATG

GAGGCACGAGTGGCCTGGGGAGCGCTGGCCGGACCTCTGCGGGTTCTCTG

CGTCCTGTGCTGCCTGTTGGGCCGCGCCATCGCTGCACCATCGCCCATCA

TCAAGTTCCCCGGCGATGTCGCCCCTAAAACAGACAAAGAGTTGGCAGTG

CAATACCTGAACACTTTCTATGGCTGCCCCAAGGAGAGTTGCAACCTCTT

TGTGCTGAAAGATACCCTCAAGAAGATGCAGAAGTTCTTTGGGCTGCCCC

AGACAGGTGACCTTGACCAGAACACCATCGAGACCATGCGGAAGCCAAGA

TGTGGCAACCCAGATGTGGCCAACTACAACTTCTTCCCCCGCAAGCCCAA

GTGGGACAAGAACCAGATCACATACAGGATCATTGGTTACACACCTGACC

TGGACCCTGAAACCGTGGATGATGCTTTTGCTCGGGCCTTAAAAGTATGG

AGCGACGTCACTCCGCTGCGCTTTTCTCGAATCCATGATGGGGAGGCTGA

CATCATGATCAACTTTGGACGCTGGGAGCATGGAGATGGATACCCATTTG

ATGGCAAGGATGGACTCCTGGCACATGCCTTTGCCCCGGGCACTGGTGTT

GGGGGAGATTCTCACTTTGATGATGATGAGCTGTGGACCCTGGGAGAAGG

ACAAGTGGTCCGCGTAAAGTATGGGAACGCTGATGGCGAGTACTGCAAGT

TCCCCTTCCTGTTCAACGGTCGGGAATACAGCAGCTGTACAGACACTGGT

CGCAGTGATGGCTTCCTCTGGTGCTCCACCACATACAACTTTGAGAAGGA

TGGCAAGTATGCTTCTGCCCCCATGAAGCTTGTTTACCATGGGTGGCA

ATGCAGATGGACAGCCCTGCAAGTTCCCGTTCCGCTTCCAGGGCACCTCC

-continued

TACAACAGCTGTACCACCGAGGGCCGCACCGATGGCTACCGCTGGTGTGG

CACCACCGAGGACTATGACCGGGATAAGAAGTATGGATTCTGTCCCGAGA

CCGCTATGTCCACTGTGGGTGGAAATTCAGAAGGTGCCCCATGTGTCTTC

CCCTTCACTTTCCTGGGCAACAAGTATGAGAGCTGCACCAGCGCCGGCCG

CAACGATGGCAAGGTGTGGTGTGCGACCACAACCAACTACGATGATGACC

GGAAGTGGGGCTTCTGTCCTGACCAAGGATATAGCCTATTCCTCGTGGCA

GCCCATGAGTTCGGCCATGCCATGGGGCTGGAACACTCTCAGGACCCTGG

AGCTCTGATGGCCCCGATCTACACCTACACCAAGAACTTCCGATTATCCC

ATGATGACATCAAGGGGATCCAGGAGCTCTATGGGCCCTCCCCCGATGCT

GATACTGACACTGGTACTGGCCCCACACCAACACTGGGACCTGTCACTCC

GGAGATCTGCAAACAGGACATTGTCTTTGATGGCATCGCTCAGATCCGTG

GTGAGATCTTCTTCTTCAAGGACCGGTTTATTTGGCGGACAGTGACACCA

CGTGACAAGCCCACAGGTCCCTTGCTGGTGGCCACATTCTGGCCTGAGCT

CCCAGAAAAGATTGACGCTGTGTATGAGGCCCCACAGGAGGAGAAGGCTG

TGTTCTTCGCAGGGAATGAGTACTGGGTCTATTCTGCTAGTACTCTGGAG

CGAGGATACCCCAAGCCACTGACCAGCCTGGGGTTGCCCCCTGATGTCCA

GCAAGTAGATGCTGCCTTTAACTGGAGTAAGAACAAGAAGACATACATCT

TTGCAGGAGACAAGTTCTGGAGATACAATGAAGTGAAGAAGAAAATGGAC

CCCGGTTTCCCTAAGCTCATCGCAGACTCCTGGAATGCCATCCCTGATAA

CCTGGATGCCGTCGTGGACCTGCAGGGTGGTGGTCATAGCTACTTCTTCA

AGGGTGCTTATTACCTGAAGCTGGAGAACCAAAGTCTCAAGAGCGTGAAG

TTTGGAAGCATCAAATCAGACTGGCTGGGCTGCTGAGCTGGCCCTGTTCC

CACGGGCCCTATCATCTTCATCGCTGCACACCAGGTGAAGGATGTGAAGC

AGCCTGGCGGCTCTGTCCTCCTCTGTAGTTAACCAGCCTTCTCCTTCACC

TGGTGACTTCAGATTTAAGAGGGTGGCTTCTTTTTGTGCCCAAAGAAAGG

TGCTGACTGTACCCTCCCGGGTGCTGCTTCTCCTTCCTGCCCACCCTAGG

GGATGCTTGGATATTTGCAATGCAGCCCTCCTCTGGGCTGCCCTGGTGCT

CCACTCTTCTGGTTCTTCAACATCTATGACCTTTTTATGGCTTTCAGCAC

TCTCAGAGTTAATAGAGACTGGCTTAGGAGGGCACTGGTGGCCCTGTTAA

CAGCCTGGCATGGGGCAGTGGGGTACAGGTGTGCCAAGGTGGAAATCAGA

GACACCTGGTTTCACCCTTTCTGCTGCCCAGACACCTGCACCACCTTAAC

TGTTGCTTTTGTATGCCCTTCGCTCGTTTCCTTCAACCTTTTCAGTTTTC

CACTCCACTGCATTTCCTGCCCAAAGGACTCGGGTTGTCTGACATCGCTG

CATGATGCATCTCAGCCCGCCTAGTGATGGTTCCCCTCCTCACTCTGTGC

AGATCATGCCCAGTCACTTCCTCCACTGGATGGAGGAGAACCAAGTCAGT

GGCTTCCTGCTCAGCCTTCTTGCTTCTCCCTTTAACAGTTCCCCATGGGA

AATGGCAAACAAGTATAAATAAAGACACCCATTGAGTGACAAAAAAAAA

AAAAAAAAAAAAAAAAAA translation = "MEARVAWGALAGPLRVLCVLCCLLGRAIAAPSPII
KFPGDVAPKTDKELAVQYLNTFYGCPKESCNLFVLKDTLKKMQKFFGLPQ
TGDLDQNTIETMRKPRCGNPDVANYNFFPRKPKWDKNQITYRIIGYTPDL
DPETVDDAFARALKVWSDVTPLRFSRIHDGEADIMINFGRWEHGDGYPFD
GKDGLLAHAFAPGTGVGGDSHFDDDELWTLGEGQVVRVKYGNADGEYCKF

```
PFLFNGREYSSCTDTGRSDGFLWCSTTYNFEKDGKYGFCPHEALFTMGGN
ADGQPCKFPFRFQGTSYNSCTTEGRTDGYRWCGTTEDYDRDKKYGFCPET
AMSTVGGNSEGAPCVFPFTFLGNKYESCTSAGRNDGKVWCATTTNYDDDR
KWGFCPDQGYSLFLVAAHEFGHAMGLEHSQDPGALMAPIYTYTKNFRLSH
DDIKGIQELYGPSPDADTDTGTGPTPTLGPVTPEICKQDIVFDGIAQIRG
EIFFFKDRFIWRTVTPRDKPTGPLLVATFWPELPEKIDAVYEAPQEEKAV
FFAGNEYWVYSASTLERGYPKPLTSLGLPPDVQQVDAAFNWSKNKKTYIF
AGDKFWRYNEVKKKMDPGFPKLIADSWNAIPDNLDAVVDLQGGGHSYFFK
GAYYLKLENQSLKSVKFGSIKSDWLGC"
```

Small molecule inhibitors of MMP-2. A MMP-9/MMP-2 binding protein described herein can be used in combination with a small molecule inhibitor. For example, because the inhibitors are used in combination, the dose of the small molecule used can be decreased and/or result in fewer side effects. Examples of small molecule MMP-2 inhibitors include (2-((Isopropoxy)-(1,1'-biphenyl-4-ylsulfonyl)-amino))-N-hydroxyacetamide (Calbiochem, #444288) and N-arylsulfonyl-N-alkoxyaminoacetohydroxamic acid.

Small interfering RNA inhibitors of MMP-2. MMP-2 can be inhibited by small interfering RNA (siRNA). Examples of siRNA that can be used include:

```
MMP-2 siRNA
5'-CUUUAGAUAUACAAAGGGAtt-3'

3'-ttGAAAUCUAUAUGUUUCCCU-5'

MMP-2 siRNA2
5'-GGAGAGUUGCAACCUCUUUtt-3'

3'-ttCCUCUCAACGUUGGAGAAA-5'
```

See also Kawasaki et al., Feb. 10, 2008, *Nat. Med.* advance on-line publication doi:10.1038/nm1723. The siRNA can be administered to inhibit MMP-2, e.g., in combination with a MMP-9/MMP-2 binding protein described herein.

Drug Conjugates

The MMP-9/MMP-2 binding proteins described herein can be conjugated to a drug (e.g., a cytotoxic, cytostatic, or immunomodulatory agent). The conjugates can be used therapeutically or prophylactically, e.g., the binding protein can target the drug, e.g., in vivo, e.g., to a site of disease (e.g., a tumor or site of inflammation), e.g., such that the drug affects the site of disease (e.g., causes a cytostatic or cytotoxic effect on targeted cells).

In some embodiments, the binding protein itself has therapeutic or prophylactic efficacy (e.g., the protein can modulate (e.g., antagonize) MMP-9 and MMP-2, or cause a cytostatic or cytotoxic effect on a cell that expresses MMP-9 or MMP-2 (e.g., an endothelial cell or tumor cell)). The binding protein-drug conjugate can be used such that the binding protein and drug both contribute (e.g., additively or synergistically) to an effect on MMP-9 and/or MMP-2 (e.g., a therapeutic effect, e.g., in vivo, e.g., to a site of disease (e.g., a tumor or site of undesired angiogenesis or vascularization). The drug and/or binding protein can be, for example, cytotoxic, cytostatic or otherwise prevent or reduce the ability of a targeted cell to divide and/or survive (e.g., when the drug is taken up or internalized by the targeted cell and/or upon binding of the binding protein to MMP-9 or MMP-2). For example, if the targeted cell is a cancer cell, the drug and/or binding protein can prevent or reduce the ability of the cell to divide and/or metastasize.

Useful classes of drugs that can be used in the binding protein-drug conjugates described herein include cytotoxic or immunomodulatory agents such as, for example, antitubulin agents, auristatins, DNA minor groove binders, DNA replication inhibitors, alkylating agents (e.g., platinum complexes such as cis-platin, mono(platinum), bis(platinum) and tri-nuclear platinum complexes and carboplatin), anthracyclines, antibiotics, antifolates, antimetabolites, chemotherapy sensitizers, duocarmycins, etoposides, fluorinated pyrimidines, ionophores, lexitropsins, nitrosoureas, platinols, pre-forming compounds, purine antimetabolites, puromycins, radiation sensitizers, steroids, taxanes, topoisomerase inhibitors, vinca alkaloids, or the like.

Individual cytotoxic or immunomodulatory agents include, for example, an androgen, anthramycin (AMC), asparaginase, 5-azacytidine, azathioprine, bleomycin, busulfan, buthionine sulfoximine, camptothecin, carboplatin, carmustine (BSNU), CC-1065, chlorambucil, cisplatin, colchicine, cyclophosphamide, cytarabine, cytidine arabinoside, cytochalasin B, dacarbazine, dactinomycin (actinomycin), daunorubicin, decarbazine, docetaxel, doxorubicin, an estrogen, 5-fluorodeoxyuridine, 5-fluorouracil, gramicidin D, hydroxyurea, idarubicin, ifosfamide, irinotecan, lomustine (CCNU), mechlorethamine, melphalan, 6-mercaptopurine, methotrexate, mithramycin, mitomycin C, mitoxantrone, nitroimidazole, paclitaxel, plicamycin, procarbazine, rapamycin (Sirolimus), streptozotocin, tenoposide, 6-thioguanine, thioTEPA, topotecan, vinblastine, vincristine, vinorelbine, VP-16 and VM-26.

In some typical embodiments, the drug comprises a cytotoxic agent. Suitable cytotoxic agents include, for example, dolastatins (e.g., auristatin E, AFP, MMAF, MMAE), DNA minor groove binders (e.g., enediynes and lexitropsins), duocarmycins, taxanes (e.g., paclitaxel and docetaxel), puromycins, vinca alkaloids, CC-1065, SN-38, topotecan, morpholino-doxorubicin, rhizoxin, cyanomorpholino-doxorubicin, echinomycin, combretastatin, netropsin, epothilone A and B, estramustine, cryptophysins, cemadotin, maytansinoids, discodermolide, eleutherobin, and mitoxantrone.

In some embodiments, the drug is a cytotoxic agent such as AFP, MMAF, MMAE, AEB, AEVB, auristatin E, paclitaxel, docetaxel, CC-1065, SN-38, topotecan, morpholino-doxorubicin, rhizoxin, cyanomorpholino-doxorubicin, dolastatin-10, echinomycin, combretatstatin, chalicheamicin, maytansine, DM-1, or netropsin.

In some embodiments, the drug is a cytotoxic agent that comprises a conventional chemotherapeutic such as, for example, doxorubicin, paclitaxel, melphalan, vinca alkaloids, methotrexate, mitomycin C or etoposide. In some embodiments, the drug can be a combined therapy, such as CHOP (Cyclophosphamide, Doxorubicin, Prednisolone and Vincristine), CHOP-R (Cyclophosphamide, Doxorubicin Vincristine, Prednisolone, and rituximab) or ABVD (Doxorubicin, Bleomycin, Vinblastine and Dacarbazine). Agents such as CC-1065 analogues (e.g., DC1), calicheamicin, maytansine, analogues of dolastatin 10, rhizoxin, and palytoxin can also be used.

In specific embodiments, the drug can be a cytotoxic or cytostatic agent that comprises auristatin E (also known in the art as dolastatin-10) or a derivative thereof. Typically, the auristatin E derivative is, e.g., an ester formed between auristatin E and a keto acid. For example, auristatin E can be reacted with paraacetyl benzoic acid or benzoylvaleric acid to produce AEB and AEVB, respectively. Other auristatin derivatives include AFP, MMAF, and MMAE. The synthesis and structure of auristatin E and its derivatives are described in US 20030083263 and US 20050009751, and U.S. Pat. Nos. 6,323,315; 6,239,104; 6,034,065; 5,780,588; 5,665,860; 5,663,149; 5,635,483; 5,599,902; 5,554,725; 5,530,097; 5,521,284; 5,504,191; 5,410,024; 5,138,036; 5,076,973;

4,986,988; 4,978,744; 4,879,278; 4,816,444; and 4,486,414. In some preferred embodiments, MMAF or AFP is used.

In specific embodiments, the drug is a cytotoxic agent that comprises a DNA minor groove binding agent. See, e.g., U.S. Pat. No. 6,130,237. For example, in some embodiments, the minor groove binding agent is a CBI compound. In other embodiments, the minor groove binding agent is an enediyne (e.g., calicheamicin).

Examples of anti-tubulin agents that can be used in the MMP-9/MMP-2 binding protein-drug conjugates include, but are not limited to, taxanes (e.g., TAXOL® (paclitaxel), TAXOTERE® (docetaxel)), T67 (Tularik), vinca alkyloids (e.g., vincristine, vinblastine, vindesine, and vinorelbine), and dolastatins (e.g., auristatin E, AFP, MMAF, MMAE, AEB, AEVB). Other antitubulin agents include, for example, baccatin derivatives, taxane analogs (e.g., epothilone A and B), nocodazole, colchicine and colcimid, estramustine, cryptophysins, cemadotin, maytansinoids, combretastatins, discodermolide, eleutherobin, rhizoxin/maytansine, auristatin dolastatin 10 MMAE, and peloruside A.

In some embodiments, the drug is a cytotoxic agent such as an anti-tubulin agent. In some embodiments, the anti-tubulin agent is an auristatin, a vinca alkyloid, a podophyllotoxin, a taxane, a baccatin derivative, a cryptophysin, a maytansinoid, a combretastatin, or a dolastatin. In some embodiments, the antitubulin agent is AFP, MMAP, MMAE, AEB, AEVB, auristatin E, vincristine, vinblastine, vindesine, vinorelbine, VP-16, camptothecin, paclitaxel, docetaxel, epothilone A, epothilone B, nocodazole, colchicines, colcimid, estramustine, cemadotin, discodermolide, maytansine, DM1, DM2, DM3, DM4, or eleutherobin.

In some embodiments, the cytotoxic agent comprises a maytansinoid, another group of anti-tubulin agents. For example, in specific embodiments, the maytansinoid is maytansine or DM-1 (ImmunoGen, Inc.; see also Chari et al. Cancer Res. 52:127-131 (1992)). In some embodiments, sterically hindered thiol and disulfide-containing maytansinoids in which the alpha-carbon atom bearing the sulfur atom bears one or two alkyl substituents are used in the binding protein-drug conjugate, e.g., US 2007-0292422; US 2007-0264266.

In some embodiments, the drug comprises an agent that acts to disrupt DNA. The drug may be selected from enediynes (e.g., calicheamicin and esperamicin) and non-enediyne small molecule agents (e.g., bleomycin, methidium-propyl-EDTA-Fe(II)). Other useful drugs include daunorubicin, doxorubicin, distamycin A, cisplatin, mitomycin C, ecteinascidins, duocarmycin/CC-1065, and bleomycin/pepleomycin.

In other embodiments, the drug can comprise an alkylating agent such as Asaley NSC 167780, AZQ NSC 182986, BCNU NSC 409962, Busulfan NSC 750, carboxyphthalatoplatinum NSC 271674, CBDCA NSC 241240, CCNU NSC 79037, CHIP NSC 256927, chlorambucil NSC 3088, chlorozotocin NSC 178248, cis-platinum NSC 119875, clomesone NSC 338947, cyanomorpholinodoxorubicin NSC 357704, cyclodisone NSC 348948, dianhydrogalactitol NSC 132313, fluorodopan NSC 73754, hepsulfam NSC 329680, hycanthone NSC 142982, melphalan NSC 8806, methyl CCNU NSC 95441, mitomycin C NSC 26980, mitozolamide NSC 353451, nitrogen mustard NSC 762, PCNU NSC 95466, piperazine NSC 344007, piperazinedione NSC 135758, pipobroman NSC 25154, porfiromycin NSC 56410, spirohydantoin mustard NSC 172112, teroxirone NSC 296934, tetraplatin NSC 363812, thio-tepa NSC 6396, triethylenemelamine NSC 9706, uracil nitrogen mustard NSC 34462, or Yoshi-864 NSC 102627.

In some embodiments, the drug can comprise an antimitotic agent such as allocolchicine NSC 406042, Halichondrin B NSC 609395, colchicine NSC 757, colchicine derivative NSC 33410, dolastatin 10 NSC 376128 (NG—auristatin derived), maytansine NSC 153858, rhizoxin NSC 332598, taxol NSC 125973, taxol derivative NSC 608832, thiocolchicine NSC 361792, trityl cysteine NSC 83265, vinblastine sulfate NSC 49842, or vincristine sulfate NSC 67574.

In other embodiments, the drug can comprise an topoisomerase I inhibitor such as camptothecin NSC 94600, camptothecin, Na salt NSC 100880, aminocamptothecin NSC 603071, camptothecin derivative NSC 95382, camptothecin derivative NSC 107124, camptothecin derivative NSC 643833, camptothecin derivative NSC 629971, camptothecin derivative NSC 295500, camptothecin derivative NSC 249910, camptothecin derivative NSC 606985, camptothecin derivative NSC 374028, camptothecin derivative NSC 176323, camptothecin derivative NSC 295501, camptothecin derivative NSC 606172, camptothecin derivative NSC 606173, camptothecin derivative NSC 610458, camptothecin derivative NSC 618939, camptothecin derivative NSC 610457, camptothecin derivative NSC 610459, camptothecin derivative NSC 606499, camptothecin derivative NSC 610456, camptothecin derivative NSC 364830, camptothecin derivative NSC 606497, or morpholinodoxorubicin NSC 354646.

In other embodiments, the drug can comprise an topoisomerase II inhibitor such as doxorubicin NSC 123127, amonafide NSC 308847, m-AMSA NSC 249992, anthrapyrazole derivative NSC 355644, pyrazoloacridine NSC 366140, bisantrene HCL NSC 337766, daunorubicin NSC 82151, deoxydoxorubicin NSC 267469, mitoxantrone NSC 301739, menogaril NSC 269148, N,N-dibenzyl daunomycin NSC 268242, oxanthrazole NSC 349174, rubidazone NSC 164011, VM-26 NSC 122819, or VP-16 NSC 141540.

In other embodiments, the drug can comprise an RNA or DNA antimetabolite such as L-alanosine NSC 153353, 5-azacytidine NSC 102816, 5-fluorouracil NSC 19893, acivicin NSC 163501, aminopterin derivative NSC 132483, aminopterin derivative NSC 184692, aminopterin derivative NSC 134033, an antifol NSC 633713, an antifol NSC 623017, Baker's soluble antifol NSC 139105, dichlorallyl lawsone NSC 126771, brequinar NSC 368390, ftorafur (pro-drug) NSC 148958, 5,6-dihydro-5-azacytidine NSC 264880, methotrexate NSC 740, methotrexate derivative NSC 174121, N-(phosphonoacetyl)-L-aspartate (PALA) NSC 224131, pyrazofurin NSC 143095, trimetrexate NSC 352122, 3-HP NSC 95678, 2'-deoxy-5-fluorouridine NSC 27640, 5-HP NSC 107392, alpha-TGDR NSC 71851, aphidicolin glycinate NSC 303812, ara-C NSC 63878, 5-aza-2'-deoxycytidine NSC 127716, beta-TGDR NSC 71261, cyclocytidine NSC 145668, guanazole NSC 1895, hydroxyurea NSC 32065, inosine glycodialdehyde NSC 118994, macbecin 11 NSC 330500, pyrazoloimidazole NSC 51143, thioguanine NSC 752, or thiopurine NSC 755. See also US 2007-0292441.

The abbreviation "AFP" refers to dimethylvaline-valine-dolaisoleuine-dolaproine-phenylalanine-p-phenylenediamine (e.g., see Formula XVI in US 2006-0233794).

The abbreviation "MAE" refers to monomethyl auristatin E (see Formula XI in US 2006-0233794).

The abbreviation "AEB" refers to an ester produced by reacting auristatin E with paraacetyl benzoic acid (e.g., see Formula XX in US 2006-0233794)

The abbreviation "AEVB" refers to an ester produced by reacting auristatin E with benzoylvaleric acid (e.g., see Formula XXI in US 2006-0233794).

The abbreviation "MMAF" refers to dovaline-valine-dolaisoleunine-dolaproine-phenylalanine (e.g., see Formula IVIV in US 2006-0233794).

The abbreviations "fk" and "phe-lys" refer to the linker phenylalanine-lysine.

The abbreviations "vc" and "val-cit" refer to the linker valine-citrulline.

In some embodiments, the drug is a cytotoxic agent selected from the group consisting of an auristatin, a DNA minor groove binding agent, a DNA minor groove alkylating agent, an enediyne, a lexitropsin, a duocarmycin, a taxane, a puromycin, a dolastatin, a maytansinoid, and a vinca alkaloid.

In some embodiments, the drug is a cytotoxic agent such as AFP or MMAF.

In some embodiments, the drug is an immunosuppressive agent such as gancyclovir, etanercept, cyclosporine, tacrolimus, rapamycin, cyclophosphamide, azathioprine, mycophenolate mofetil, methotrexate, cortisol, aldosterone, dexamethasone, a cyclooxygenase inhibitor, a 5-lipoxygenase inhibitor, or a leukotriene receptor antagonist.

See generally US 2007-0292441; US 2007-0292422; US 2007-0264266; and US 2006-0233794.

Linkers

The binding proteins described herein can be associated with a drug to form a binding protein-drug conjugate by being linked to the drug directly. In some embodiments, the binding protein is directly conjugated to the drug. Alternatively, the binding proteins described herein can be associated with a drug to form a binding protein-drug conjugate by use of a linker region between the drug and the binding protein. In some embodiments, the binding protein is conjugated to the drug via a linker. The linker can be cleavable under intracellular conditions, e.g., such that cleavage of the linker releases the drug from the binding protein in the intracellular environment. In some embodiments, the cleavable linker is a peptide linker cleavable by an intracellular protease. In some embodiments, the peptide linker is a dipeptide linker.

In some embodiments, the dipeptide linker is a val-cit (vc) linker or a phe-lys (fk) linker. In some embodiments, the cleavable linker is hydrolyzable at a pH of less than 5.5. In some embodiments, the hydrolyzable linker is a hydrazone linker. In some embodiments, the cleavable linker is a disulfide linker.

For example, in some embodiments, the linker is cleavable by a cleaving agent that is present in the intracellular environment (e.g., within a lysosome or endosome or caveolea). The linker can be, e.g., a peptidyl linker that is cleaved by an intracellular peptidase or protease enzyme, including, but not limited to, a lysosomal or endosomal protease. In some embodiments, the peptidyl linker is at least two amino acids long or at least three amino acids long. Cleaving agents can include cathepsins B and D and plasmin, which are known to hydrolyze dipeptide drug derivatives resulting in the release of active drug inside target cells (see, e.g., Dubowchik and Walker *Pharm. Therapeutics* 83:67-123 (1999)). In some embodiments, peptidyl linkers are cleavable by enzymes that are present in targeted cells (e.g., cancer cells). For example, a peptidyl linker that is cleavable by the thiol-dependent protease cathepsin-B, which is highly expressed in cancerous tissue, can be used (e.g., a Phe-Leu or a Gly-Phe-Leu-Gly linker(SEQ ID NO: 1277)). Other such linkers are described, e.g., in U.S. Pat. No. 6,214,345. In some embodiments, the peptidyl linker cleavable by an intracellular protease is a Val-Cit (vc) linker or a Phe-Lys linker (fk) (see, e.g., U.S. Pat. No. 6,214,345, which describes the synthesis of doxorubicin with the val-cit linker). One advantage of using intracellular proteolytic release of the drug is that the drug can be attenuated when conjugated and the serum stabilities of the conjugates are typically high.

In some preferred embodiments, a vc linker is used in the binding protein-drug conjugates described herein. For example, a binding protein-vcAFP or a binding protein-vcMMAF conjugate (e.g., a MMP-9/MMP-2 binding protein-vcAFP or a MMP-9/MMP-2 binding protein-vcMMAF conjugate) is prepared.

In other embodiments, the cleavable linker is pH-sensitive, i.e., sensitive to hydrolysis at certain pH values. For example, the pH-senstive linker is hydrolyzable under acidic conditions. For example, an acid-labile linker that is hydrolyzable in the lysosome (e.g., a hydrazone, semicarbazone, thiosemicarbazone, cis-aconitic amide, orthoester, acetal., ketal., or the like) can be used. See, e.g., U.S. Pat. Nos. 5,122,368; 5,824,805; 5,622,929; Dubowchik and Walker *Pharm. Therapeutics* 83:67-123 (1999); Neville et al. *Biol. Chem.* 264:14653-14661 (1989). Such linkers are relatively stable under neutral pH conditions, such as those in the blood, but are unstable at below pH 5.5 or 5.0, the approximate pH of the lysosome. In certain embodiments, the hydrolyzable linker is a thioether linker (such as, e.g., a thioether attached to the therapeutic agent via an acylhydrazone bond (see, e.g., U.S. Pat. No. 5,622,929)).

In yet other embodiments, the linker is cleavable under reducing conditions (e.g., a disulfide linker). A variety of disulfide linkers are known in the art, including, for example, those that can be formed using SATA (N-succinimidyl-S-acetylthioacetate), SPDP (N-succinimidyl-3-(2-pyridyldithio)propionate), SPDB (N-succinimidyl-3-(2-pyridyldithio)butyrate) and SMPT (N-succinimidyl-oxycarbonyl-alpha-methyl-alpha-(2-pyridyl-dithio) toluene)-, SPDB and SMPT (See, e.g., Thorpe et al. *Cancer Res.* 47:5924-5931 (1987); Wawrzynczak et al., In Immunoconjugates: Antibody Conjugates in Radioimagery and Therapy of Cancer (C. W. Vogel ed., Oxford U. Press, 1987). See also U.S. Pat. No. 4,880,935.

In yet other embodiments, the linker is a malonate linker (Johnson et al. *Anticancer Res.* 15:1387-93 (1995)), a maleimidobenzoyl linker (Lau et al. *Bioorg-Med-Chem.* 3(10): 1299-1304 (1995), or a 3'-N-amide analog (Lau et al. *Bioorg-Med-Chem.* 3(10):1305-12 (1995)).

In some embodiments, the linker is not substantially sensitive to the extracellular environment. As used herein, "not substantially sensitive to the extracellular environment," in the context of a linker, means that no more than about 20%, typically no more than about 15%, more typically no more than about 10%, and even more typically no more than about 5%, no more than about 3%, or no more than about 1% of the linkers, in a sample of a binding protein-drug conjugate, are cleaved when the binding protein-drug conjugate is present in an extracellular environment (e.g., in plasma). Whether a linker is not substantially sensitive to the extracellular environment can be determined, for example, by incubating independently with plasma both (a) the binding protein-drug conjugate (the "conjugate sample") and (b) an equal molar amount of unconjugated binding protein or drug (the "control sample") for a predetermined time period (e.g., 2, 4, 8, 16, or 24 hours) and then comparing the amount of unconjugated binding protein or drug present in the conjugate sample with that present in control sample, as measured, for example, by high performance liquid chromatography.

In other, non-mutually exclusive embodiments, the linker promotes cellular internalization. In certain embodiments, the linker promotes cellular internalization when conjugated to the drug (i.e., in the milieu of the linker-drug moiety of the binding protein-drug conjugate described herein). In yet other embodiments, the linker promotes cellular internalization when conjugated to both the drug and the binding protein.

A variety of linkers that can be used with the present compositions and methods are described in WO 2004010957.

In some embodiments, the binding protein-drug conjugates described herein are used therapeutically in the treatment of a disorder (e.g., cancer or inflammation). In certain embodiments, it is desirable to only target a binding protein-drug conjugate to a cell that expresses the target to which the binding protein binds (e.g., to only target a MMP-9 or MMP-2 expressing cell to which a MMP-9/MMP-2 binding protein binds, and not target a nearby "bystander" cell), e.g., to minimize toxicity. In other embodiments, it is desirable to target a binding protein-drug conjugate to a cell expressing the target to which the binding protein binds and also to bystander cells (e.g., to elicit a "bystander effect"). In some embodiments, a binding protein-drug conjugate (e.g., a MMP-9 binding protein-drug conjugate can be engineered to exert a precise killing of only antigen-presenting cells without damaging proximal antigen-negative tissues, e.g., by preparing thioether-linked conjugates. Alternatively, it can be engineered to produce a bystander effect, e.g., by preparing disulfide-linked conjugates.

For example, many solid tumors express targets (e.g., antigens) in a heterogeneous fashion and are populated with both target-positive and target-negative cells. The bystander cytotoxicity associated with disulfide linker-containing conjugates provides a rationale for treatment of sites of a disorder (e.g., tumors) with binding protein-drug conjugates even if the sites exhibit heterogeneous target expression. The bystander effect adds a degree of nonselective killing activity. Potentially, this could be a drawback if normal cells in tissues surrounding the site of disorder (e.g., tumor) are affected. However, as a potential advantage, the bystander cytotoxicity may damage tissues intricately involved in supporting the disorder, such as endothelial cells and pericytes of tumor neovasculature, or tumor stromal cells, resulting, for example, in enhanced antitumor activity of the binding protein-drug conjugate against tumors expressing the antigen either homogeneously or heterogeneously. See also Kovtum et al. *Cancer Res.* 66:3214 (2006).

Techniques for conjugating therapeutic agents to proteins (such as binding proteins, e.g., MMP-9/MMP-2 binding proteins) are known. See, e.g., Amon et al., "Monoclonal Antibodies For Immunotargeting Of Drugs In Cancer Therapy," in Monoclonal Antibodies And Cancer Therapy (Reisfeld et al eds., Alan R. Liss, Inc., 1985); Hellstrom et al., "Antibodies For Drug Delivery," in Controlled Drug Delivery (Robinson et al. eds., Marcel Deiker, Inc., 2nd ed. 1987); Thorpe, "Antibody Carriers Of Cytotoxic Agents In Cancer Therapy: A Review," in Monoclonal Antibodies '84: Biological And Clinical Applications (Pinchera et al. eds., 1985); "Analysis, Results, and Future Prospective of the Therapeutic Use of Radiolabeled Antibody In Cancer Therapy," in Monoclonal Antibodies For Cancer Detection And Therapy (Baldwin et al. eds., Academic Press, 1985); and Thorpe et al. *Immunol. Rev.* 62:119-58 (1982). See also, e.g., US 2006-0233794 and PCT publication WO 89/12624.

Display Libraries

A display library is a collection of entities; each entity includes an accessible polypeptide component and a recoverable component that encodes or identifies the polypeptide component. The polypeptide component is varied so that different amino acid sequences are represented. The polypeptide component can be of any length, e.g. from three amino acids to over 300 amino acids. A display library entity can include more than one polypeptide component, for example, the two polypeptide chains of a sFab. In one exemplary implementation, a display library can be used to identify proteins that bind to MMP-9. In a selection, the polypeptide component of each member of the library is probed with MMP-9 (e.g., the catalytic domain of MMP-9 or other fragment) and if the polypeptide component binds to the MMP-9, the display library member is identified, typically by retention on a support.

Retained display library members are recovered from the support and analyzed. The analysis can include amplification and a subsequent selection under similar or dissimilar conditions. For example, positive and negative selections can be alternated. The analysis can also include determining the amino acid sequence of the polypeptide component and purification of the polypeptide component for detailed characterization.

The retained family members are subjected to a subsequent analysis to recover binding proteins that also bind to MMP-2.

A variety of formats can be used for display libraries. Examples include the following.

Phage Display: The protein component is typically covalently linked to a bacteriophage coat protein. The linkage results from translation of a nucleic acid encoding the protein component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem.* 274:18218-30; Hoogenboom et al. (1998) *Immunotechnology* 4:1-20; Hoogenboom et al. (2000) *Immunol Today* 2:371-8 and Hoet et al. (2005) *Nat. Biotechnol.* 23(3)344-8. Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be picked, the nucleic acid isolated and sequenced.

Other Display Formats. Other display formats include cell based display (see, e.g., WO 03/029456), protein-nucleic acid fusions (see, e.g., U.S. Pat. No. 6,207,446), ribosome display (See, e.g., Mattheakis et al. (1994) *Proc. Natl. Acad. Sci. USA* 91:9022 and Hanes et al. (2000) *Nat. Biotechnol.* 18:1287-92; Hanes et al. (2000) *Methods Enzymol.* 328:404-30; and Schaffitzel et al. (1999) *J Immunol Methods.* 231(1-2):119-35), and *E. coli* periplasmic display (J Immunol Methods. 2005 Nov. 22; PMID: 16337958).

Scaffolds. Scaffolds useful for display include: antibodies (e.g., Fab fragments, single chain Fv molecules (scFV), single domain antibodies, camelid antibodies, and camelized antibodies); T-cell receptors; MHC proteins; extracellular domains (e.g., fibronectin Type III repeats, EGF repeats); protease inhibitors (e.g., Kunitz domains, ecotin, BPTI, and so forth); TPR repeats; trifoil structures; zinc finger domains; DNA-binding proteins; particularly monomeric DNA binding proteins; RNA binding proteins; enzymes, e.g., proteases (particularly inactivated proteases), RNase; chaperones, e.g., thioredoxin and heat shock proteins; intracellular signaling domains (such as SH2 and SH3 domains); linear and constrained peptides; and linear peptide substrates. Display libraries can include synthetic and/or natural diversity. See, e.g., US 2004-0005709.

Display technology can also be used to obtain binding proteins (e.g., antibodies) that bind particular epitopes of a target. This can be done, for example, by using competing non-target molecules that lack the particular epitope or are mutated within the epitope, e.g., with alanine. Such non-target molecules can be used in a negative selection procedure as described below, as competing molecules when binding a display library to the target, or as a pre-elution agent, e.g., to capture in a wash solution dissociating display library members that are not specific to the target.

Iterative Selection. In one preferred embodiment, display library technology is used in an iterative mode. A first display library is used to identify one or more binding proteins for a target. These identified binding proteins are then varied using a mutagenesis method to form a second display library. Higher affinity binding proteins are then selected from the second library, e.g., by using higher stringency or more competitive binding and washing conditions.

In some implementations, the mutagenesis is targeted to regions at the binding interface. If, for example, the identified binding proteins are antibodies, then mutagenesis can be directed to the CDR regions of the heavy or light chains as described herein. Further, mutagenesis can be directed to framework regions near or adjacent to the CDRs. In the case of antibodies, mutagenesis can also be limited to one or a few of the CDRs, e.g., to make precise step-wise improvements. Exemplary mutagenesis techniques include: error-prone PCR, recombination, DNA shuffling, site-directed mutagenesis and cassette mutagenesis.

In one example of iterative selection, the methods described herein are used to first identify a protein from a display library that binds MMP-9 with at least a minimal binding specificity for a target or a minimal activity, e.g., an equilibrium dissociation constant for binding of less than 1 nM, 10 nM, or 100 nM. The nucleic acid sequence encoding the initially identified proteins are used as a template nucleic acid for the introduction of variations, e.g., to identify a second protein that has enhanced properties (e.g., binding affinity, kinetics, or stability) relative to the initial protein. The methods also include identifying a protein from a display library that binds MMP-2 with at least a minimal binding specificity for a target or a minimal activity, e.g., an equilibrium dissociation constant for binding of less than 1 nM, 10 nM, or 100 nM.

Off-Rate Selection. Since a slow dissociation rate can be predictive of high affinity, particularly with respect to interactions between polypeptides and their targets, the methods described herein can be used to isolate binding proteins with a desired (e.g., reduced) kinetic dissociation rate for a binding interaction to a target.

To select for slow dissociating binding proteins from a display library, the library is contacted to an immobilized target. The immobilized target is then washed with a first solution that removes non-specifically or weakly bound biomolecules. Then the bound binding proteins are eluted with a second solution that includes a saturating amount of free target or a target specific high-affinity competing monoclonal antibody, i.e., replicates of the target that are not attached to the particle. The free target binds to biomolecules that dissociate from the target. Rebinding is effectively prevented by the saturating amount of free target relative to the much lower concentration of immobilized target.

The second solution can have solution conditions that are substantially physiological or that are stringent. Typically, the solution conditions of the second solution are identical to the solution conditions of the first solution. Fractions of the second solution are collected in temporal order to distinguish early from late fractions. Later fractions include biomolecules that dissociate at a slower rate from the target than biomolecules in the early fractions.

Further, it is also possible to recover display library members that remain bound to the target even after extended incubation. These can either be dissociated using chaotropic conditions or can be amplified while attached to the target. For example, phage bound to the target can be contacted to bacterial cells.

Selecting or Screening for Specificity. The display library screening methods described herein can include a selection or screening process that discards display library members that bind to a non-target molecule. Examples of non-target molecules include streptavidin on magnetic beads, blocking agents such as bovine serum albumin, non-fat bovine milk, any capturing or target immobilizing monoclonal antibody, or non-transfected cells which do not express the human MMP-9 target.

In one implementation, a so-called "negative selection" step is used to discriminate between the target and related non-target molecule and a related, but distinct non-target molecules. The display library or a pool thereof is contacted to the non-target molecule. Members of the sample that do not bind the non-target are collected and used in subsequent selections for binding to the target molecule or even for subsequent negative selections. The negative selection step can be prior to or after selecting library members that bind to the target molecule.

In another implementation, a screening step is used. After display library members are isolated for binding to the target molecule, each isolated library member is tested for its ability to bind to a non-target molecule (e.g., a non-target listed above). For example, a high-throughput ELISA screen can be used to obtain this data. The ELISA screen can also be used to obtain quantitative data for binding of each library member to the target as well as for cross species reactivity to related targets or subunits of the target (e.g., mouse MMP-9) and also under different condition such as pH6 or pH 7.5. The non-target and target binding data are compared (e.g., using a computer and software) to identify library members that specifically bind to the target.

Other Exemplary Expression Libraries

Other types of collections of proteins (e.g., expression libraries) can be used to identify proteins with a particular property (e.g., ability to bind MMP-9 or MMP-2 and/or ability to modulate MMP-9 or MMP-2), including, e.g., protein arrays of antibodies (see, e.g., De Wildt et al. (2000) Nat. Biotechnol. 18:989-994), lambda gt11 libraries, two-hybrid libraries and so forth.

Exemplary Libraries

It is possible to immunize a non-human primate and recover primate antibody genes that can be displayed on phage (see below). From such a library, one can select antibodies that bind the antigen used in immunization. See, for example, Vaccine. (2003) 22(2):257-67 or Immunogenetics. (2005) 57(10):730-8. Thus one could obtain primate antibodies that bind and inhibit MMP-9 (or MMP-2) by immunizing a chimpanzee or macaque and using a variety of means to select or screen for primate antibodies that bind and inhibit MMP-9 (or MMP-2). One can also make chimeras of primatized Fabs with human constant regions, see Curr Opin Mol. Ther. (2004) 6(6):675-83. "PRIMATIZED antibodies, genetically engineered from cynomolgus macaque monkey and human components, are structurally indistinguishable from human antibodies. They may, therefore, be less likely to cause adverse reactions in humans, making them potentially suited for long-term, chronic treatment" Curr Opin Investig Drugs. (2001) 2(5):635-8.

One exemplary type of library presents a diverse pool of polypeptides, each of which includes an immunoglobulin domain, e.g., an immunoglobulin variable domain. Of interest are display libraries where the members of the library include primate or "primatized" (e.g., such as human, non-human primate or "humanized") immunoglobin domains (e.g., immunoglobin variable domains) or chimeric primatized Fabs with human constant regions. Human or humanized immunoglobin domain libraries may be used to identify human or "humanized" antibodies that, for example, recognize human antigens. Because the constant and framework regions of the antibody are human, these antibodies may avoid themselves being recognized and targeted as antigens when administered to humans. The constant regions may also be optimized to recruit effector functions of the human immune system. The in vitro display selection process surmounts the inability of a normal human immune system to generate antibodies against self-antigens.

A typical antibody display library displays a polypeptide that includes a VH domain and a VL domain. An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay, 1988, *Ann. Rev. Immunol.* 6:381-405). The display library can display the antibody as a Fab fragment (e.g., using two polypeptide chains) or a single chain Fv (e.g., using a single polypeptide chain). Other formats can also be used.

As in the case of the Fab and other formats, the displayed antibody can include one or more constant regions as part of a light and/or heavy chain. In one embodiment, each chain includes one constant region, e.g., as in the case of a Fab. In other embodiments, additional constant regions are displayed.

Antibody libraries can be constructed by a number of processes (see, e.g., de Haard et al., 1999, *J. Biol. Chem.* 274: 18218-30; Hoogenboom et al., 1998, *Immunotechnology* 4:1-20; Hoogenboom et al., 2000, *Immunol. Today* 21:371-378, and Hoet et al. (2005) *Nat. Biotechnol.* 23(3)344-8. Further, elements of each process can be combined with those of other processes. The processes can be used such that variation is introduced into a single immunoglobulin domain (e.g., VH or VL) or into multiple immunoglobulin domains (e.g., VH and VL). The variation can be introduced into an immunoglobulin variable domain, e.g., in the region of one or more of CDR1, CDR2, CDR3, FR1, FR2, FR3, and FR4, referring to such regions of either and both of heavy and light chain variable domains. The variation(s) may be introduced into all three CDRs of a given variable domain, or into CDR1 and CDR2, e.g., of a heavy chain variable domain. Any combination is feasible. In one process, antibody libraries are constructed by inserting diverse oligonucleotides that encode CDRs into the corresponding regions of the nucleic acid. The oligonucleotides can be synthesized using monomeric nucleotides or trinucleotides. For example, Knappik et al., 2000, *J. Mol. Biol.* 296:57-86 describe a method for constructing CDR encoding oligonucleotides using trinucleotide synthesis and a template with engineered restriction sites for accepting the oligonucleotides.

In another process, an animal, e.g., a rodent, is immunized with MMP-9 (or MMP-2). The animal is optionally boosted with the antigen to further stimulate the response. Then spleen cells are isolated from the animal, and nucleic acid encoding VH and/or VL domains is amplified and cloned for expression in the display library.

In yet another process, antibody libraries are constructed from nucleic acid amplified from naïve germline immunoglobulin genes. The amplified nucleic acid includes nucleic acid encoding the VH and/or VL domain. Sources of immunoglobulin-encoding nucleic acids are described below. Amplification can include PCR, e.g., with primers that anneal to the conserved constant region, or another amplification method.

Nucleic acid encoding immunoglobulin domains can be obtained from the immune cells of, e.g., a primate (e.g., a human), mouse, rabbit, camel, or rodent. In one example, the cells are selected for a particular property. B cells at various stages of maturity can be selected. In another example, the B cells are naïve.

In one embodiment, fluorescent-activated cell sorting (FACS) is used to sort B cells that express surface-bound IgM, IgD, or IgG molecules. Further, B cells expressing different isotypes of IgG can be isolated. In another preferred embodiment, the B or T cell is cultured in vitro. The cells can be stimulated in vitro, e.g., by culturing with feeder cells or by adding mitogens or other modulatory reagents, such as antibodies to CD40, CD40 ligand or CD20, phorbol myristate acetate, bacterial lipopolysaccharide, concanavalin A, phytohemagglutinin, or pokeweed mitogen.

In another embodiment, the cells are isolated from a subject that has a disease of condition described herein, e.g., a cancer (e.g., metastatic cancer, e.g., metastatic breast cancer), an inflammatory disease (e.g., synovitis, atherosclerosis), rheumatoid arthritis, osteoarthritis, an ocular condition (e.g., macular degeneration), diabetes, Alzheimer's Disease, cerebral ischemia, endometriosis, fibrin-invasive activity, angiogenesis, or capillary tube formation In another embodiment, the cells are isolated from a transgenic non-human animal that includes a human immunoglobulin locus.

In one preferred embodiment, the cells have activated a program of somatic hypermutation. Cells can be stimulated to undergo somatic mutagenesis of immunoglobulin genes, for example, by treatment with anti-immunoglobulin, anti-CD40, and anti-CD38 antibodies (see, e.g., Bergthorsdottir et al., 2001, *J. Immunol.* 166:2228). In another embodiment, the cells are naïve.

The nucleic acid encoding an immunoglobulin variable domain can be isolated from a natural repertoire by the following exemplary method. First, RNA is isolated from the immune cell. Full length (i.e., capped) mRNAs are separated (e.g. by degrading uncapped RNAs with calf intestinal phosphatase). The cap is then removed with tobacco acid pyrophosphatase and reverse transcription is used to produce the cDNAs.

The reverse transcription of the first (antisense) strand can be done in any manner with any suitable primer. See, e.g., de Haard et al., 1999, *J. Biol. Chem.* 274:18218-30. The primer binding region can be constant among different immunoglobulins, e.g., in order to reverse transcribe different isotypes of immunoglobulin. The primer binding region can also be specific to a particular isotype of immunoglobulin. Typically, the primer is specific for a region that is 3' to a sequence encoding at least one CDR. In another embodiment, poly-dT primers may be used (and may be preferred for the heavy-chain genes).

A synthetic sequence can be ligated to the 3' end of the reverse transcribed strand. The synthetic sequence can be used as a primer binding site for binding of the forward primer during PCR amplification after reverse transcription. The use of the synthetic sequence can obviate the need to use a pool of different forward primers to fully capture the available diversity.

The variable domain-encoding gene is then amplified, e.g., using one or more rounds. If multiple rounds are used, nested primers can be used for increased fidelity. The amplified nucleic acid is then cloned into a display library vector.

Secondary Screening Methods

After selecting candidate library members that bind to a target, each candidate library member can be further analyzed, e.g., to further characterize its binding properties for the target, e.g., MMP-9, or for binding to other protein, e.g., MMP-2. Each candidate library member can be subjected to one or more secondary screening assays. The assay can be for a binding property, a catalytic property, an inhibitory property, a physiological property (e.g., cytotoxicity, renal clearance, immunogenicity), a structural property (e.g., stability, conformation, oligomerization state) or another functional property. The same assay can be used repeatedly, but with varying conditions, e.g., to determine pH, ionic, or thermal sensitivities.

As appropriate, the assays can use a display library member directly, a recombinant polypeptide produced from the nucleic acid encoding the selected polypeptide, or a synthetic peptide synthesized based on the sequence of the selected polypeptide. In the case of selected Fabs, the Fabs can be evaluated or can be modified and produced as intact IgG proteins. Exemplary assays for binding properties include the following.

ELISA. Binding proteins can be evaluated using an ELISA assay. For example, each protein is contacted to a microtitre plate whose bottom surface has been coated with the target, e.g., a limiting amount of the target. The plate is washed with buffer to remove non-specifically bound polypeptides. Then the amount of the binding protein bound to the target on the plate is determined by probing the plate with an antibody that can recognize the binding protein, e.g., a tag or constant portion of the binding protein. The antibody is linked to a detection system (e.g., an enzyme such as alkaline phosphatase or horse radish peroxidase (HRP) which produces a colorimetric product when appropriate substrates are provided).

Homogeneous Binding Assays. The ability of a binding protein described herein to bind a target can be analyzed using a homogenous assay, i.e., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means, e.g., using a fluorimeter. By titrating the amount of the first or second binding molecule, a binding curve can be generated to estimate the equilibrium binding constant.

Another example of a homogenous assay is ALPHASCREEN™ (Packard Bioscience, Meriden Conn.). ALPHASCREEN™ uses two labeled beads. One bead generates singlet oxygen when excited by a laser. The other bead generates a light signal when singlet oxygen diffuses from the first bead and collides with it. The signal is only generated when the two beads are in proximity. One bead can be attached to the display library member, the other to the target. Signals are measured to determine the extent of binding.

Surface Plasmon Resonance (SPR). The interaction of binding protein and a target can be analyzed using SPR. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of surface plasmon resonance (SPR)). The changes in the refractivity generate a detectable signal, which are measured as an indication of real-time reactions between biological molecules. Methods for using SPR are described, for example, in U.S. Pat. No. 5,641,640; Raether, 1988, Surface Plasmons Springer Verlag; Sjolander and Urbaniczky, 1991, *Anal. Chem.* 63:2338-2345; Szabo et al., 1995, *Curr. Opin. Struct. Biol.* 5:699-705 and on-line resources provide by BIAcore International AB (Uppsala, Sweden). BIAcore Flexchip can be used to compare and rank interactions in real time, in terms of kinetics, affinity or specificity without the use of labels.

Information from SPR can be used to provide an accurate and quantitative measure of the equilibrium dissociation constant ($K_d$), and kinetic parameters, including $K_{on}$ and $K_{off}$, for the binding of a binding protein to a target. Such data can be used to compare different biomolecules. For example, selected proteins from an expression library can be compared to identify proteins that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by x-ray crystallography or NMR). As a result, an understanding of the physical interaction between the protein and its target can be formulated and used to guide other design processes.

Cellular Assays. Binding proteins can be screened for ability to bind to cells which transiently or stably express and display the target of interest on the cell surface. For example, MMP-9/MMP-2 binding proteins can be fluorescently labeled and binding to MMP-9 or MMP-2 in the presence of absence of antagonistic antibody can be detected by a change in fluorescence intensity using flow cytometry e.g., a FACS machine.

Other Exemplary Methods for Obtaining MMP-9/MMP-2 Binding Antibodies

In addition to the use of display libraries, other methods can be used to obtain a MMP-9/MMP-2 binding antibody. For example, MMP-9 protein, MMP-2 protein or a region from either can be used as an antigen in a non-human animal, e.g., a rodent.

In one embodiment, the non-human animal includes at least a part of a human immunoglobulin gene. For example, it is possible to engineer mouse strains deficient in mouse antibody production with large fragments of the human Ig loci.

Using the hybridoma technology, antigen-specific monoclonal antibodies (Mabs) derived from the genes with the desired specificity may be produced and selected. See, e.g., XENOMOUSE™, Green et al., 1994, *Nat. Gen.* 7:13-21; U.S. 2003-0070185, WO 96/34096, published Oct. 31, 1996, and PCT Application No. PCT/US96/05928, filed Apr. 29, 1996.

In another embodiment, a monoclonal antibody is obtained from the non-human animal, and then modified, e.g., humanized or deimmunized. Winter describes a CDR-grafting method that may be used to prepare the humanized antibodies (UK Patent Application GB 2188638A, filed on Mar. 26, 1987; U.S. Pat. No. 5,225,539. All of the CDRs of a particular human antibody may be replaced with at least a portion of a non-human CDR or only some of the CDRs may be replaced with non-human CDRs. It is only necessary to replace the number of CDRs required for binding of the humanized antibody to a predetermined antigen.

Humanized antibodies can be generated by replacing sequences of the Fv variable region that are not directly involved in antigen binding with equivalent sequences from human Fv variable regions. General methods for generating humanized antibodies are provided by Morrison, S. L., 1985, *Science* 229:1202-1207, by Oi et al., 1986, *BioTechniques* 4:214, and by Queen et al. U.S. Pat. Nos. 5,585,089, 5,693,761 and 5,693,762. Those methods include isolating, manipulating, and expressing the nucleic acid sequences that encode all or part of immunoglobulin Fv variable regions from at least one of a heavy or light chain. Numerous sources of such nucleic acid are available. For example, nucleic acids may be obtained from a hybridoma producing an antibody against a predetermined target, as described above. The recombinant DNA encoding the humanized antibody, or fragment thereof, can then be cloned into an appropriate expression vector.

Reducing Immunogenicity of MMP-9/MMP-2 Binding Proteins

Immunoglobin MMP-9/MMP-2 binding proteins (e.g., IgG or Fab MMP-9/MMP-2 binding proteins) may be modified to reduce immunogenicity. Reduced immunogenicity is desirable in MMP-9/MMP-2 binding proteins intended for use as therapeutics, as it reduces the chance that the subject will develop an immune response against the therapeutic molecule. Techniques useful for reducing immunogenicity of MMP-9/MMP-2 binding proteins include deletion/modification of potential human T cell epitopes and 'germlining' of sequences outside of the CDRs (e.g., framework and Fc).

An MMP-9/MMP-2 binding antibody may be modified by specific deletion of human T cell epitopes or "deimmunization" by the methods disclosed in WO 98/52976 and WO 00/34317. Briefly, the heavy and light chain variable regions of an antibody are analyzed for peptides that bind to MHC Class II; these peptides represent potential T-cell epitopes (as defined in WO 98/52976 and WO 00/34317). For detection of potential T-cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable regions, or preferably, by single amino acid substitutions. As far as possible conservative substitutions are made, often but not exclusively, an amino acid common at this position in human germline antibody sequences may be used. Human germline sequences are disclosed in Tomlinson, I. A. et al., 1992, *J. Mol. Biol.* 227:776-798; Cook, G. P. et al., 1995, *Immunol. Today* Vol. 16 (5): 237-242; Chothia, D. et al., 1992, *J. Mol. Bio.* 227:799-817. The V BASE directory provides a comprehensive directory of human immunoglobulin variable region sequences (compiled by Tomlinson, I. A. et al. MRC Centre for Protein Engineering, Cambridge, UK). After the deimmunizing changes are identified, nucleic acids encoding VH and VL can be constructed by mutagenesis or other synthetic methods (e.g., de novo synthesis, cassette replacement, and so forth). Mutagenized variable sequence can, optionally, be fused to a human constant region, e.g., human IgG1 or K constant regions.

In some cases a potential T cell epitope will include residues which are known or predicted to be important for antibody function. For example, potential T cell epitopes are usually biased towards the CDRs. In addition, potential T cell epitopes can occur in framework residues important for antibody structure and binding. Changes to eliminate these potential epitopes will in some cases require more scrutiny, e.g., by making and testing chains with and without the change. Where possible, potential T cell epitopes that overlap the CDRs were eliminated by substitutions outside the CDRs. In some cases, an alteration within a CDR is the only option, and thus variants with and without this substitution should be tested. In other cases, the substitution required to remove a potential T cell epitope is at a residue position within the framework that might be critical for antibody binding. In these cases, variants with and without this substitution should be tested. Thus, in some cases several variant deimmunized heavy and light chain variable regions were designed and various heavy/light chain combinations tested in order to identify the optimal deimmunized antibody. The choice of the final deimmunized antibody can then be made by considering the binding affinity of the different variants in conjunction with the extent of deimmunization, i.e., the number of potential T cell epitopes remaining in the variable region. Deimmunization can be used to modify any antibody, e.g., an antibody that includes a non-human sequence, e.g., a synthetic antibody, a murine antibody other non-human monoclonal antibody, or an antibody isolated from a display library.

MMP-9/MMP-2 binding antibodies are "germlined" by reverting one or more non-germline amino acids in framework regions to corresponding germine amino acids of the antibody, so long as binding properties are substantially retained. Similar methods can also be used in the constant region, e.g., in constant immunoglobulin domains.

Antibodies that bind to MMP-9 and MMP-2, e.g., an antibody described herein, may be modified in order to make the variable regions of the antibody more similar to one or more germline sequences. For example, an antibody can include one, two, three, or more amino acid substitutions, e.g., in a framework, CDR, or constant region, to make it more similar to a reference germline sequence. One exemplary germlining method can include identifying one or more germline sequences that are similar (e.g., most similar in a particular database) to the sequence of the isolated antibody. Mutations (at the amino acid level) are then made in the isolated antibody, either incrementally or in combination with other mutations. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a framework and/or constant region. For example, a germline framework and/or constant region residue can be from a germline sequence that is similar (e.g., most similar) to the non-variable region being modified. After mutagenesis, activity (e.g., binding or other functional activity) of the antibody can be evaluated to determine if the germline residue or residues are tolerated (i.e., do not abrogate activity). Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may including using two germline sequences that separately contribute to the amino-terminal portion and the carboxy-terminal portion. In other implementations more than one or two germline sequences are used, e.g., to form a consensus sequence.

In one embodiment, with respect to a particular reference variable domain sequence, e.g., a sequence described herein, a related variable domain sequence has at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at least 30, 50, 60, 70, 80, 85, 90, 91, 92, 93, 94, 95, 96, 97, 98, 99 or 100% of the FR regions identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, or 99.5% identical to a germline sequence in a region outside the CDRs (e.g., framework regions). Further, an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity as measured by $K_A$) can be within a factor or 100, 10, 5, 2, 0.5, 0.1, and 0.001 of the original antibody.

Germline sequences of human immunoglobin genes have been determined and are available from a number of sources, including the international ImMunoGeneTics information System® (IMGT), available via the world wide web at imgt-.cines.fr, and the V BASE directory (compiled by Tomlinson, I. A. et al. MRC Centre for Protein Engineering, Cambridge, UK, available via the world wide web at vbase.mrc-cpe.cam.ac.uk).

Exemplary germline reference sequences for $V_{kappa}$ include: O12/O2, O18/O8, A20, A30, L14, L1, L15, L4/18a, L5/L19, L8, L23, L9, L24, L11, L12, O11/O1, A17, A1, A18, A2, A19/A3, A23, A27, A11, L2/L16, L6, L20, L25, B3, B2, A26/A10, and A14. See, e.g., Tomlinson et al., 1995, *EMBO J.* 14(18):4628-3.

A germline reference sequence for the HC variable domain can be based on a sequence that has particular canonical structures, e.g., 1-3 structures in the H1 and H2 hypervariable loops. The canonical structures of hypervariable loops of an immunoglobulin variable domain can be inferred from its sequence, as described in Chothia et al., 1992, *J. Mol. Biol.* 227:799-817; Tomlinson et al., 1992, *J. Mol. Biol.* 227:776-798); and Tomlinson et al., 1995, *EMBO J.* 14(18):4628-38. Exemplary sequences with a 1-3 structure include: DP-1, DP-8, DP-12, DP-2, DP-25, DP-15, DP-7, DP-4, DP-31, DP-32, DP-33, DP-35, DP-40, 7-2, hv3005, hv3005f3, DP-46, DP-47, DP-58, DP-49, DP-50, DP-51, DP-53, and DP-54.

Protein Production

Standard recombinant nucleic acid methods can be used to express a protein that binds to MMP-9 and MMP-2. Generally, a nucleic acid sequence encoding the protein is cloned into a nucleic acid expression vector. Of course, if the protein includes multiple polypeptide chains, each chain can be cloned into an expression vector, e.g., the same or different vectors, that are expressed in the same or different cells.

Antibody Production. Some antibodies, e.g., Fabs, can be produced in bacterial cells, e.g., *E. coli* cells. For example, if the Fab is encoded by sequences in a phage display vector that includes a suppressible stop codon between the display entity and a bacteriophage protein (or fragment thereof), the vector nucleic acid can be transferred into a bacterial cell that cannot suppress a stop codon. In this case, the Fab is not fused to the gene III protein and is secreted into the periplasm and/or media.

Antibodies can also be produced in eukaryotic cells. In one embodiment, the antibodies (e.g., scFv's) are expressed in a yeast cell such as *Pichia* (see, e.g., Powers et al., 2001, *J. Immunol. Methods.* 251:123-35), Hanseula, or *Saccharomyces*.

In one preferred embodiment, antibodies are produced in mammalian cells. Preferred mammalian host cells for expressing the clone antibodies or antigen-binding fragments thereof include Chinese Hamster Ovary (CHO cells) (including dhfr-CHO cells, described in Urlaub and Chasin, 1980, *Proc. Natl. Acad. Sci. USA* 77:4216-4220, used with a DHFR selectable marker, e.g., as described in Kaufman and Sharp, 1982, *Mol. Biol.* 159:601 621), lymphocytic cell lines, e.g., NS0 myeloma cells and SP2 cells, COS cells, HEK293T cells (*J. Immunol. Methods* (2004) 289(1-2):65-80.), and a cell from a transgenic animal, e.g., a transgenic mammal. For example, the cell is a mammary epithelial cell.

In addition to the nucleic acid sequence encoding the diversified immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399,216, 4,634,665 and 5,179,017). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr⁻ host cells with methotrexate selection/amplification) and the neo gene (for G418 selection).

In an exemplary system for recombinant expression of an antibody, or antigen-binding portion thereof, a recombinant expression vector encoding both the antibody heavy chain and the antibody light chain is introduced into dhfr⁻ CHO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G coupled matrix.

For antibodies that include an Fc domain, the antibody production system may produce antibodies in which the Fc region is glycosylated. For example, the Fc domain of IgG molecules is glycosylated at asparagine 297 in the CH2 domain. This asparagine is the site for modification with biantennary-type oligosaccharides. It has been demonstrated that this glycosylation is required for effector functions mediated by Fcg receptors and complement C1q (Burton and Woof, 1992, *Adv. Immunol.* 51:1-84; Jefferis et al., 1998, *Immunol. Rev.* 163:59-76). In one embodiment, the Fc domain is produced in a mammalian expression system that appropriately glycosylates the residue corresponding to asparagine 297. The Fc domain can also include other eukaryotic post-translational modifications.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly. Characterization of MMP-9/MMP-2 Binding Proteins Binding of MMP-9/MMP-2 binding proteins to cells expressing MMP-9 and/or MMP-2 can be characterized in a number assays known in the art, including FACS (Fluorescence Activated Cell Sorting), immunofluorescence, and immunocytochemistry. MMP-9/MMP-2 binding protein is contacted with cells and/or tissues which express or contain MMP-9 and/or MMP-2, and binding is detected in accordance with the method being used. For example, a fluorescent detection system (e.g., fluorescent-labeled secondary antibody) employed for FACS and immunofluorescence analysis, or an enzymatic system is used for immunocytochemistry are generally used in these assays can be performed on non-perm. MMP-9/MMP-2 binding proteins can be characterized as to cellular binding by FACS (Fluorescence Activated Cell Sorting) using cells expressing MMP-9 and/or MMP-2. Individual cells held in a thin stream of fluid are passed through one or more laser beams cause light to scatter and fluorescent dyes to emit light at various frequencies. Photomultiplier tubes (PMT) convert light to electrical signals and cell data is collected. Forward and side scatter are used for preliminary identification of cells. Forward and side scatter are used to exclude debris and dead cells. Fluorescent labeling allows investigation of cell structure and function. Cell autofluorescence is generated by labeling cell structures with fluorescent dyes. FACS collects fluorescence signals in one to several channels corresponding to different laser excitation and fluorescence emission wavelength. Immunofluorescence, the most widely used application, involves the staining of cells with antibodies conjugated to fluorescent dyes such as fluorescein and phycoerythrin (PE). This method can be used to label MMP-9 or MMP-2 on the cell surface of MDA-MB-231 cells using biotinylated MMP-9/MMP-2 binding proteins. Biotin is used in these two-step detection systems in concert with conjugated streptavidin. Biotin is typically conjugated to proteins via primary amines (i.e., lysines). Usually, between 1.5 and 3 biotin molecules are conjugated to each antibody. A second fluorescently conjugated antibody (streptavidin/PE) is added which is specific for biotin.

MMP-9/MMP-2 binding proteins can be characterized in cultured cells expressing the MMP-9 antigen or the MMP-2 antigen. The method generally used is immunocytochemistry. Immunocytochemistry involves the use of antibodies that recognize parts of the receptor that are exposed to the outside environment when expressed at the cell surface (the 'primary antibody'). If the experiment is carried out in intact cells, such an antibody will only bind to surface expressed receptors. Biotinylated or non-biotinylated MMP-9/MMP-2 binding proteins can be used. The secondary antibody is then either a streptavidin/HRP antibody (for biotinylated MMP-9/MMP-2 binding protein) or an anti-human IgG/HRP (for non-biotinylated MMP-9/MMP-2 binding protein). The staining can then be detected using an inverted microscope. The assay can be performed in the absence of MMP-9/MMP-2 binding protein and in presence of 10 µg/mL of MMP-9/MMP-2 binding protein.

MMP-9/MMP-2 binding proteins can be characterized in assays that measure their modulatory activity toward MMP-9, MMP-2 or fragments thereof in vitro or in vivo. For example, MMP-9 (or MMP-2) can be combined with a substrate such as Mca-Pro-Leu-Ala-Cys(Mob)-Trp-Ala-Arg-Dap(Dnp)-NH$_2$ (SEQ ID NO: 1278)under assay conditions permitting cleavage by MMP-9 (or MMP-2). The assay is performed in the absence of the MMP-9/MMP-2 binding protein, and in the presence of increasing concentrations of the MMP-9/MMP-2 binding protein. The concentration of binding protein at which 50% of the MMP-9 activity (or MMP-2 activity) (e.g., binding to the substrate) is inhibited is the IC$_{50}$ value (Inhibitory Concentration 50%) or EC$_{50}$ (Effective Concentration 50%) value for that binding protein. Within a series or group of binding proteins, those having lower IC$_{50}$ or EC$_{50}$ values are considered more potent inhibitors of MMP-9 (or MMP-2) than those binding proteins having higher IC$_{50}$ or EC$_{50}$ values. Exemplary binding proteins have an IC$_{50}$ value of less than 800 nM, 400 nM, 100 nM, 25 nM, 5 nM, or 1 nM, e.g., as measured in an in vitro assay for inhibition of MMP-9 activity (or MMP-2 activity) when the MMP-9 (or MMP-2) is at 2 pM.

MMP-9/MMP-2 binding proteins may also be characterized with reference to the activity of MMP-9 or MMP-2 on substrates (e.g., collagen, gelatin). For example, cleavage of gelatin by MMP-9 can be detected in zymography. The method is based on a SDS gel impregnated with a substrate, which is degraded by the proteases resolved during the incubation period. Coomassie blue staining of the gels reveals proteolytic fragments as white bands on a dark blue background. Within a certain range, the band intensity can be related linearly to the amount of the protease loaded. Cells expressing both MMP-9 and MMP-2 are used in this assay. The assay is performed in the absence of the MMP-9/MMP-2 binding protein, and in the presence of increasing concentrations of the MMP-9/MMP-2 binding protein. The concentration of binding protein at which 50% of the MMP-9 activity (e.g., binding to the substrate) is inhibited is the $IC_{50}$ value (Inhibitory Concentration 50%) or $EC_{50}$ (Effective Concentration 50%) value for that binding protein. Within a series or group of binding proteins, those having lower $IC_{50}$ or $EC_{50}$ values are considered more potent inhibitors of MMP-9 than those binding proteins having higher $IC_{50}$ or $EC_{50}$ values. Exemplary binding proteins have an $IC_{50}$ value of less than 800 nM, 400 nM, 100 nM, 25 nM, 5 nM, or 1 nM, e.g., as measured in an in vitro assay for inhibition of MMP-9 activity. The same is true for binding and inhibition of MMP-2.

The binding proteins can also be evaluated for selectivity toward MMP-9 or MMP-2. For example, a MMP-9/MMP-2 binding protein can be assayed for its potency toward MMP-9, MMP-2 and a panel of MMPs and other enzymes, e.g., human and/or mouse enzymes, e.g., MMP-1, -3, -7, -8, -12, -13, -14, -16, -17, -24, and TACE, and an $IC_{50}$ value or $EC_{50}$ value can be determined for each MMP. In one embodiment, a compound that demonstrates a low $IC_{50}$ value or $EC_{50}$ value for the MMP-9, and a higher $IC_{50}$ value or $EC_{50}$ value, e.g., at least 2-, 5-, or 10-fold higher, for another MMP within the test panel (e.g., MMP-1, -10) is considered to be selective toward MMP-9.

MMP-9/MMP-2 binding proteins can be evaluated for their ability to inhibit MMP-9 in a cell based assay.

A pharmacokinetics study in rat, mice, or monkey can be performed with MMP-9/MMP-2 binding proteins for determining MMP-9 or MMP-2 half-life in the serum. Likewise, the effect of the binding protein can be assessed in vivo, e.g., in an animal model for a disease, for use as a therapeutic, for example, to treat a disease or condition described herein, e.g., a cancer (e.g., metastatic cancer, e.g., metastatic breast cancer), an inflammatory disease (e.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration).

Pharmaceutical Compositions

In another aspect, the disclosure provides compositions, e.g., pharmaceutically acceptable compositions or pharmaceutical compositions, which include an MMP-9/MMP-2 binding protein, e.g., an antibody molecule, other polypeptide or peptide identified as binding to MMP-9 and MMP-2 described herein. The MMP-9/MMP-2 binding protein can be formulated together with a pharmaceutically acceptable carrier. Pharmaceutical compositions include therapeutic compositions and diagnostic compositions, e.g., compositions that include labeled MMP-9/MMP-2 binding proteins for in vivo imaging.

A pharmaceutically acceptable carrier includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal, or epidermal administration (e.g., by injection or infusion), although carriers suitable for inhalation and intranasal administration are also contemplated. Depending on the route of administration, the MMP-9/MMP-2 binding protein may be coated in a material to protect the compound from the action of acids and other natural conditions that may inactivate the compound.

A pharmaceutically acceptable salt is a salt that retains the desired biological activity of the parent compound and does not impart any undesired toxicological effects (see e.g., Berge, S. M., et al., 1977, *J. Pharm. Sci.* 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous, and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids, and the like. Base addition salts include those derived from alkaline earth metals, such as sodium, potassium, magnesium, calcium, and the like, as well as from nontoxic organic amines, such as N,N'-dibenzylethylenediamine, N-methylglucamine, chloroprocaine, choline, diethanolamine, ethylenediamine, procaine, and the like.

The compositions may be in a variety of forms. These include, for example, liquid, semi-solid and solid dosage forms, such as liquid solutions (e.g., injectable and infusible solutions), dispersions or suspensions, tablets, pills, powders, liposomes and suppositories. The form can depend on the intended mode of administration and therapeutic application. Many compositions are in the form of injectable or infusible solutions, such as compositions similar to those used for administration of humans with antibodies. An exemplary mode of administration is parenteral (e.g., intravenous, subcutaneous, intraperitoneal, intramuscular). In one embodiment, the MMP-9 binding protein is administered by intravenous infusion or injection. In another preferred embodiment, the MMP-9/MMP-2 binding protein is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

The composition can be formulated as a solution, microemulsion, dispersion, liposome, or other ordered structure suitable to high drug concentration. Sterile injectable solutions can be prepared by incorporating the binding protein in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

An MMP-9/MMP-2 binding protein can be administered by a variety of methods, although for many applications, the preferred route/mode of administration is intravenous injection or infusion. For example, for therapeutic applications, the MMP-9 binding protein can be administered by intravenous infusion at a rate of less than 30, 20, 10, 5, or 1 mg/min to reach a dose of about 1 to 100 mg/m² or 7 to 25 mg/m². The route and/or mode of administration will vary depending upon the desired results. In certain embodiments, the active compound may be prepared with a carrier that will protect the compound against rapid release, such as a controlled release formulation, including implants, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are available. See, e.g., Sustained and Controlled Release Drug Delivery Systems, J. R. Robinson, ed., 1978, Marcel Dekker, Inc., New York.

Pharmaceutical compositions can be administered with medical devices. For example, in one embodiment, a pharmaceutical composition disclosed herein can be administered with a device, e.g., a needleless hypodermic injection device, a pump, or implant.

In certain embodiments, an MMP-9/MMP-2 binding protein can be formulated to ensure proper distribution in vivo. For example, the blood-brain barrier (BBB) excludes many highly hydrophilic compounds. To ensure that the therapeutic compounds disclosed herein cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties that are selectively transported into specific cells or organs, thus enhance targeted drug delivery (see, e.g., V. V. Ranade, 1989, *J. Clin. Pharmacol.* 29:685).

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms can be dictated by and directly dependent on (a) the unique characteristics of the active compound and the particular therapeutic effect to be achieved, and (b) the limitations inherent in the art of compounding such an active compound for the treatment of sensitivity in individuals.

An exemplary, non-limiting range for a therapeutically or prophylactically effective amount of an antibody disclosed herein is 0.1-20 mg/kg, more preferably 1-10 mg/kg. An anti-MMP-9 antibody can be administered, e.g., by intravenous infusion, e.g., at a rate of less than 30, 20, 10, 5, or 1 mg/min to reach a dose of about 1 to 100 mg/m$^2$ or about 5 to 30 mg/m$^2$. For binding proteins smaller in molecular weight than an antibody, appropriate amounts can be proportionally less. Dosage values may vary with the type and severity of the condition to be alleviated. For a particular subject, specific dosage regimens can be adjusted over time according to the individual need and the professional judgment of the person administering or supervising the administration of the compositions.

The pharmaceutical compositions disclosed herein may include a "therapeutically effective amount" or a "prophylactically effective amount" of an MMP-9/MMP-2 binding protein disclosed herein. A "therapeutically effective amount" refers to an amount effective, at dosages and for periods of time necessary, to achieve the desired therapeutic result. A therapeutically effective amount of the composition may vary according to factors such as the disease state, age, sex, and weight of the individual, and the ability of the protein to elicit a desired response in the individual. A therapeutically effective amount is also one in which any toxic or detrimental effects of the composition is outweighed by the therapeutically beneficial effects.

A "therapeutically effective dosage" preferably modulates a measurable parameter, e.g., levels of circulating IgG antibodies or enzymatic activity, by a statistically significant degree or at least about 20%, more preferably by at least about 40%, even more preferably by at least about 60%, and still more preferably by at least about 80% relative to untreated subjects. The ability of a compound to modulate a measurable parameter, e.g., a disease-associated parameter, can be evaluated in an animal model system predictive of efficacy in human disorders and conditions, e.g., a cancer (e.g., metastatic cancer, e.g., metastatic breast cancer), an inflammatory disease (e.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration). Alternatively, this property of a composition can be evaluated by examining the ability of the compound to modulate a parameter in vitro.

A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount will be less than the therapeutically effective amount.

Stabilization and Retention

In one embodiment, an MMP-9/MMP-2 binding protein is physically associated with a moiety that improves its stabilization and/or retention in circulation, e.g., in blood, serum, lymph, or other tissues, e.g., by at least 1.5, 2, 5, 10, or 50 fold. For example, an MMP-9/MMP-2 binding protein can be associated with a polymer, e.g., a substantially non-antigenic polymer, such as polyalkylene oxides or polyethylene oxides. Suitable polymers will vary substantially by weight. Polymers having molecular number average weights ranging from about 200 to about 35,000 (or about 1,000 to about 15,000, and 2,000 to about 12,500) can be used. For example, an MMP-9/MMP-2 binding protein can be conjugated to a water soluble polymer, e.g., hydrophilic polyvinyl polymers, e.g. polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained.

An MMP-9/MMP-2 binding protein can also be associated with a carrier protein, e.g., a serum albumin, such as a human serum albumin. For example, a translational fusion can be used to associate the carrier protein with the MMP-9/MMP-2 binding protein.

Kits

An MMP-9/MMP-2 binding protein described herein can be provided in a kit, e.g., as a component of a kit. For example, the kit includes (a) an MMP-9/MMP-2 binding protein, e.g., a composition that includes an MMP-9/MMP-2 binding protein, and, optionally (b) informational material. The informational material can be descriptive, instructional, marketing or other material that relates to the methods described herein and/or the use of an MMP-9/MMP-2 binding protein for the methods described herein.

The informational material of the kits is not limited in its form. In one embodiment, the informational material can include information about production of the compound, molecular weight of the compound, concentration, date of expiration, batch or production site information, and so forth. In one embodiment, the informational material relates to using the binding protein to treat, prevent, or diagnosis of disorders and conditions, e.g., a cancer (e.g., metastatic cancer, e.g., metastatic breast cancer), an inflammatory disease (e.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration).

In one embodiment, the informational material can include instructions to administer an MMP-9/MMP-2 binding protein in a suitable manner to perform the methods described herein, e.g., in a suitable dose, dosage form, or mode of administration (e.g., a dose, dosage form, or mode of administration described herein). In another embodiment, the informational material can include instructions to administer an MMP-9/MMP-2 binding protein to a suitable subject, e.g., a human, e.g., a human having, or at risk for, a disorder or condition described herein, e.g., a cancer (e.g., metastatic cancer, e.g., metastatic breast cancer or bladder cancer), an inflammatory disease (e.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration). For example, the material can include instructions to administer an MMP-9/MMP-2 binding protein to a patient with a disorder or condition described herein, e.g., a cancer (e.g., metastatic cancer, e.g., metastatic breast cancer or bladder), an inflammatory disease (e.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration). The informational material of the kits is not limited in its form. In many cases, the informational material, e.g., instructions, is provided in print but may also be in other formats, such as computer readable material.

An MMP-9/MMP-2 binding protein can be provided in any form, e.g., liquid, dried or lyophilized form. It is preferred that an MMP-9/MMP-2 binding protein be substantially pure and/or sterile. When an MMP-9/MMP-2 binding protein is provided in a liquid solution, the liquid solution preferably is an aqueous solution, with a sterile aqueous solution being preferred. When an MMP-9/MMP-2 binding protein is provided as a dried form, reconstitution generally is by the addition of a suitable solvent. The solvent, e.g., sterile water or buffer, can optionally be provided in the kit.

The kit can include one or more containers for the composition containing an MMP-9/MMP-2 binding protein. In some embodiments, the kit contains separate containers, dividers or compartments for the composition and informational material. For example, the composition can be contained in a bottle, vial, or syringe, and the informational material can be contained association with the container. In other embodiments, the separate elements of the kit are contained within a single, undivided container. For example, the composition is contained in a bottle, vial or syringe that has attached thereto the informational material in the form of a label. In some embodiments, the kit includes a plurality (e.g., a pack) of individual containers, each containing one or more unit dosage forms (e.g., a dosage form described herein) of an MMP-9 binding protein. For example, the kit includes a plurality of syringes, ampules, foil packets, or blister packs, each containing a single unit dose of an MMP-9/MMP-2 binding protein. The containers of the kits can be air tight, waterproof (e.g., impermeable to changes in moisture or evaporation), and/or light-tight.

The kit optionally includes a device suitable for administration of the composition, e.g., a syringe, inhalant, dropper (e.g., eye dropper), swab (e.g., a cotton swab or wooden swab), or any such delivery device. In one embodiment, the device is an implantable device that dispenses metered doses of the binding protein. The disclosure also features a method of providing a kit, e.g., by combining components described herein.

Treatments

Proteins that bind to MMP-9 and MMP-2 and identified by the method described herein and/or detailed herein have therapeutic and prophylactic utilities, particularly in human subjects. These binding proteins are administered to a subject to treat, prevent, and/or diagnose a variety of disorders, including e.g., a cancer (e.g., metastatic cancer, e.g., metastatic breast canceror bladder cancer), an inflammatory disease (e.g., chronic obstructive pulmonary disease (COPD), asthma, rhinitis (e.g., allergic rhinitis), inflammatory bowel disease, synovitis, rheumatoid arthritis), heart failure (e.g., myocardial infarction, hypertension or viral myocarditis), septic shock, neuropathic pain, osteoarthritis, or an ocular condition (e.g., macular degeneration), or even to cells in culture, e.g. in vitro or ex vivo. Treating includes administering an amount effective to alleviate, relieve, alter, remedy, ameliorate, improve or affect the disorder, the symptoms of the disorder or the predisposition toward the disorder. The treatment may also delay onset, e.g., prevent onset, or prevent deterioration of a disease or condition.

Exemplary disorders include a cancer (e.g., metastatic cancer, e.g., metastatic breast cancer or bladder cancer), an inflammatory disease (.g., chronic obstructive pulmonary disease (COPD), asthma, rhinitis (e.g., allergic rhinitis), inflammatory bowel disease, synovitis, rheumatoid arthritis), heart failure (e.g., myocardial infarction, hypertension or viral myocarditis), septic shock, neuropathic pain, osteoarthritis, or an ocular condition (e.g., macular degeneration). Some of these disorders are discussed above. Still other disorders that can be treated using an MMP-9/MMP-2 binding protein include: aortic aneurysms, stroke, hemorrhage, reperfusion injury, cerebral infarction, cerebral ischemia, periodontitis, autoimmune blistering disorders of the skin, dermal photo-aging.

As used herein, an amount of an target-binding agent effective to prevent a disorder, or a prophylactically effective amount of the binding agent refers to an amount of a target binding agent, e.g., an MMP-9/MMP-2 binding protein, e.g., an anti-MMP-9/MMP-2 antibody described herein, which is effective, upon single- or multiple-dose administration to the subject, for preventing or delaying the occurrence of the onset or recurrence of a disorder, e.g., a disorder described herein.

A binding agent described herein can be used to reduce angiogenesis in a subject, e.g., to treat a cancer (e.g., a solid tumor) or an angiogenesis-associated disorder. The method includes administering the binding to the subject, e.g., in an amount effective to modulate angiogenesis, a symptom of the disorder, or progression of the disorder. The agent (e.g., an MMP-9/MMP-2 binding protein, e.g., an anti-MMP-9/MMP-2 antibody) may be administered multiple times (e.g., at least two, three, five, or ten times) before a therapeutically effective amount is attained. Methods of administering MMP-9/MMP-2 binding proteins and other agents are also described in "Pharmaceutical Compositions." Suitable dosages of the molecules used can depend on the age and weight of the subject and the particular drug used. The binding proteins can be used as competitive agents to inhibit, reduce an undesirable interaction, e.g., between a natural or pathological agent and the MMP-9 and MMP-2. The dose of the MMP-9/MMP-2 binding protein can be the amount sufficient to block 90%, 95%, 99%, or 99.9% of the activity of MMP-9/MMP-2 in the patient, especially at the site of disease. Depending on the disease, this may require 0.1, 1.0, 3.0, 6.0, or 10.0 mg/Kg. For an IgG having a molecular mass of 150,000 g/mole (two binding sites), these doses correspond to approximately 18 nM, 180 nM, 540 nM, 1.08 µM, and 1.8 µM of binding sites for a 5 L blood volume.

In one embodiment, the MMP-9/MMP-2 binding proteins are used to inhibit an activity (e.g., inhibit at least one activity of, reduce proliferation, migration, growth or viability) of a cell, e.g., a cancer cell in vivo. The binding proteins can be used by themselves or conjugated to an agent, e.g., a cytotoxic drug, cytotoxin enzyme, or radioisotope. This method includes: administering the binding protein alone or attached to an agent (e.g., a cytotoxic drug), to a subject requiring such treatment. For example, MMP-9/MMP-2 binding proteins that do not substantially inhibit MMP-9 or MMP-2 may be used to deliver nanoparticles containing agents, such as toxins, to MMP-9 and/or MMP-2 associated cells or tissues, e.g., tumors.

Because the MMP-9/MMP-2 binding proteins recognize MMP-9-expressing cells and MMP-2 expressing cells and can bind to cells that are associated with (e.g., in proximity of or intermingled with) cancer cells, e.g., cancerous lung, liver, colon, breast, ovarian, epidermal, laryngeal, and cartilage cells, and particularly metastatic cells thereof, MMP-9/MMP-2 binding proteins can be used to inhibit (e.g., inhibit at least one activity, reduce growth and proliferation, or kill) any such cells and inhibit carcinogenesis. Reducing MMP-9 activity and/or MMP-2 activity near a cancer can indirectly inhibit (e.g., inhibit at least one activity, reduce growth and proliferation, or kill) the cancer cells which may be dependent on the MMP-9 activity and/or MMP-2 activity for metastasis, activation of growth factors, and so forth.

Alternatively, the binding proteins bind to cells in the vicinity of the cancerous cells, but are sufficiently close to the cancerous cells to directly or indirectly inhibit (e.g., inhibit at least one activity, reduce growth and proliferation, or kill) the cancers cells. Thus, the MMP-9/MMP-2 binding proteins (e.g., modified with a toxin, e.g., a cytotoxin) can be used to selectively inhibit cells in cancerous tissue (including the cancerous cells themselves and cells associated with or invading the cancer).

The binding proteins may be used to deliver an agent (e.g., any of a variety of cytotoxic and therapeutic drugs) to cells and tissues where MMP-9 and/or MMP-2 is present. Exemplary agents include a compound emitting radiation, molecules of plants, fungal, or bacterial origin, biological proteins, and mixtures thereof. The cytotoxic drugs can be intracellularly acting cytotoxic drugs, such as toxins short range radiation emitters, e.g., short range, high energy α-emitters.

To target MMP-9 expressing cells and/or MMP-2 expressing cells, particularly cancerous cells, a prodrug system can be used. For example, a first binding protein is conjugated with a prodrug which is activated only when in close proximity with a prodrug activator. The prodrug activator is conjugated with a second binding protein, preferably one which binds to a non competing site on the target molecule. Whether two binding proteins bind to competing or non competing binding sites can be determined by conventional competitive binding assays. Exemplary drug prodrug pairs are described in Blakely et al., (1996) Cancer Research, 56:3287 3292.

The MMP-9/MMP-2 binding proteins can be used directly in vivo to eliminate antigen-expressing cells via natural complement-dependent cytotoxicity (CDC) or antibody dependent cellular cytotoxicity (ADCC). The binding proteins described herein can include complement binding effector domain, such as the Fc portions from IgG1, -2, or -3 or corresponding portions of IgM which bind complement. In one embodiment, a population of target cells is ex vivo treated with a binding agent described herein and appropriate effector cells. The treatment can be supplemented by the addition of complement or serum containing complement. Further, phagocytosis of target cells coated with a binding protein described herein can be improved by binding of complement proteins. In another embodiment target, cells coated with the binding protein which includes a complement binding effector domain are lysed by complement.

Methods of administering MMP-9/MMP-2 binding proteins are described in "Pharmaceutical Compositions." Suitable dosages of the molecules used will depend on the age and weight of the subject and the particular drug used. The binding proteins can be used as competitive agents to inhibit or reduce an undesirable interaction, e.g., between a natural or pathological agent and the MMP-9 or MMP-2.

The MMP-9/MMP-2 binding protein can be used to deliver macro and micromolecules, e.g., a gene into the cell for gene therapy purposes into the endothelium or epithelium and target only those tissues expressing the MMP-9 and MMP-2. The binding proteins may be used to deliver a variety of cytotoxic drugs including therapeutic drugs, a compound emitting radiation, molecules of plants, fungal, or bacterial origin, biological proteins, and mixtures thereof. The cytotoxic drugs can be intracellularly acting cytotoxic drugs, such as short range radiation emitters, including, for example, short range, high energy α emitters, as described herein.

In the case of polypeptide toxins, recombinant nucleic acid techniques can be used to construct a nucleic acid that encodes the binding protein (e.g., antibody or antigen-binding fragment thereof) and the cytotoxin (or a polypeptide component thereof) as translational fusions. The recombinant nucleic acid is then expressed, e.g., in cells and the encoded fusion polypeptide isolated.

Alternatively, the MMP-9/MMP-2 binding protein can be coupled to high energy radiation emitters, for example, a radioisotope, such as $^{131}$I, a γ-emitter, which, when localized at a site, results in a killing of several cell diameters. See, e.g., S. E. Order, "Analysis, Results, and Future Prospective of the Therapeutic Use of Radiolabeled Antibody in Cancer Therapy", *Monoclonal Antibodies for Cancer Detection and Therapy*, R. W. Baldwin et al. (eds.), pp 303 316 (Academic Press 1985). Other suitable radioisotopes include a emitters, such as $^{212}$Bi, $^{213}$Bi, and $^{211}$At, and b emitters, such as $^{186}$Re and $^{90}$Y. Moreover, $^{177}$Lu may also be used as both an imaging and cytotoxic agent.

Radioimmunotherapy (RIT) using antibodies labeled with $^{131}$I, $^{90}$Y, and $^{177}$Lu is under intense clinical investigation. There are significant differences in the physical characteristics of these three nuclides and as a result, the choice of radionuclide is very critical in order to deliver maximum radiation dose to a tissue of interest. The higher beta energy particles of $^{90}$Y may be good for bulky tumors. The relatively low energy beta particles of $^{131}$I are ideal, but in vivo dehalogenation of radioiodinated molecules is a major disadvantage for internalizing antibody. In contrast, $^{177}$Lu has low energy beta particle with only 0.2-0.3 mm range and delivers much lower radiation dose to bone marrow compared to $^{90}$Y. In addition, due to longer physical half-life (compared to $^{90}$Y), the residence times are higher. As a result, higher activities (more mCi amounts) of $^{177}$Lu labeled agents can be administered with comparatively less radiation dose to marrow. There have been several clinical studies investigating the use of $^{177}$Lu labeled antibodies in the treatment of various cancers. (Mulligan T et al., 1995, *Clin. Canc. Res.* 1: 1447-1454; Meredith R F, et al., 1996, *J. Nucl. Med.* 37:1491-1496; Alvarez R D, et al., 1997, *Gynecol. Oncol.* 65: 94-101).

Exemplary Diseases and Conditions

The MMP-9/MMP-2 binding proteins described herein are useful to treat diseases or conditions in which MMP-9 and/or MMP-2 is implicated, e.g., a disease or condition described herein, or to treat one or more symptoms associated therewith. In some embodiments, the MMP-9/MMP-2 binding protein (e.g., MMP-9/MMP-2 binding IgG or Fab) inhibits MMP-9 activity, e.g., catalytic activity, and/or MMP-2 activity, e.g., catalytic activity.

Examples of such diseases and conditions include a cancer (e.g., metastatic cancer, e.g., metastatic breast cancer), an inflammatory disease (e.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration). A therapeutically effective amount of a MMP-9/MMP-2 binding protein is administered to a subject having or suspected of having a disorder in which MMP-9 and/or MMP-2 is implicated, thereby treating (e.g., ameliorating or improving a symptom or feature of a disorder, slowing, stabilizing or halting disease progression) the disorder.

The MMP-9/MMP-2 binding protein is administered in a therapeutically effective amount. A therapeutically effective amount of an MMP-9/MMP-2 binding protein is the amount which is effective, upon single or multiple dose administration to a subject, in treating a subject, e.g., curing, alleviating, relieving or improving at least one symptom of a disorder in a subject to a degree beyond that expected in the absence of such treatment. A therapeutically effective amount of the composition may vary according to factors such as the disease state, age, sex, and weight of the individual, and the ability of the compound to elicit a desired response in the individual. A therapeutically effective amount is also one in which any toxic or detrimental effects of the composition is outweighed by the therapeutically beneficial effects.

A therapeutically effective amount can be administered, typically an amount of the compound which is effective, upon single or multiple dose administration to a subject, in treating a subject, e.g., curing, alleviating, relieving or improving at least one symptom of a disorder in a subject to a degree beyond that expected in the absence of such treatment. A therapeutically effective amount of the composition may vary according to factors such as the disease state, age, sex, and weight of the individual, and the ability of the compound to elicit a desired response in the individual. A therapeutically effective amount is also one in which any toxic or detrimental effects of the composition is outweighed by the therapeutically beneficial effects. A therapeutically effective dosage preferably modulates a measurable parameter, favorably, relative to untreated subjects. The ability of a compound to inhibit a measurable parameter can be evaluated in an animal model system predictive of efficacy in a human disorder.

Dosage regimens can be adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

Cancer

Matrix metalloproteases (MMPs), such as MMP-9 and MMP-2, are believed to contribute to cancer by cleaving components of the ECM and basement membranes, thereby allowing cancer cells to penetrate and infiltrate the subjacent stromal matrix. Additionally, a number of growth-factor receptors, cell adhesion molecules, chemokines, cytokines, apoptotic ligands, and angiogenic factors are substrates of MMPs. Hence, MMP activity may cause activation of growth factors, suppression of tumor cell apoptosis, destruction of chemokine gradients developed by host immune response, or release of angiogenic factors. MMPs may facilitate tumor growth by promoting the release of cell proliferation factors such as insulin-like growth factors which are bound to specific binding proteins (IGFBPs) (Manes et al., 1997 J. Biol. Chem. 272: 25706-25712).

Collagenases, including MMP-9 and MMP-2, have been found at elevated levels in melanoma and in cancers of the colon, breast, lung, prostate, and bladder. Usually, these elevated levels correlate with higher tumor grade and invasiveness. MMP-2 levels are significantly elevated in the serum of patients with metastatic lung cancer, and in those patients with high levels, response to chemotherapy is diminished. MMP-9 may contribute to tumor invasiveness and recurrence.

Accordingly, the disclosure provides methods of treating (e.g., slowing, eliminating, or reversing tumor growth, preventing or reducing, either in number or size, metastases, reducing or eliminating tumor cell invasiveness, providing an increased interval to tumor progression, or increasing disease-free survival time) cancer (e.g., breast cancer, including Her2+, Her2−, ER+, ER−, Her2+/ER+, Her2+/ER−, Her2−/ER+, and Her2−/ER− breast cancer), head and neck cancer, oral cavity cancer, laryngeal cancer, chondrosarcoma, bladder cancer, ovarian cancer, testicular carcinoma, melanoma, brain tumors (e.g., astrocytomas, glioblastomas, gliomas)) by administering an effective amount of an MMP-9/MMP-2 binding protein (e.g., an anti-MMP-9/MMP-2 IgG or Fab). In some embodiments, the MMP-9/MMP-2 binding protein inhibits MMP-9 activity and MMP-2 activity.

In certain embodiments, the MMP-9/MMP-2 binding protein is administered as a single agent treatment. In other embodiments, the MMP-9/MMP-2 binding protein is administered in combination with an additional anti-cancer agent.

Also provided are methods of preventing or reducing risk of developing cancer, by administering an effective amount of an MMP-9/MMP-2 binding protein to a subject at risk of developing cancer, thereby reducing the subject's risk of developing a cancer.

The disclosure further provides methods of modulating (e.g. reducing or preventing) angiogenesis at a tumor site by administering an effective amount of an MMP-9/MMP-2 binding protein, thereby reducing or preventing angiogenesis at the tumor site. The MMP-9/MMP-2 binding protein may be administered as a single agent therapy or in combination with additional agents.

Also provided are methods for reducing extracellular matrix (ECM) degradation by a tumor, comprising administering an effective amount of an MMP-9/MMP-2 binding protein to a subject, thereby reducing ECM degradation by a tumor in the subject.

The disclosed methods are useful in the prevention and treatment of solid tumors, soft tissue tumors, and metastases thereof. Solid tumors include malignancies (e.g., sarcomas, adenocarcinomas, and carcinomas) of the various organ systems, such as those of lung, breast, lymphoid, bladder, gastrointestinal (e.g., colon), and genitourinary (e.g., renal, urothelial, or testicular tumors) tracts, pharynx, prostate, and ovary. Exemplary adenocarcinomas include colorectal cancers, renal-cell carcinoma, liver cancer, non-small cell carcinoma of the lung, and cancer of the small intestine. Additional exemplary solid tumors include: fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastrointestinal system carcinomas, colon carcinoma, pancreatic cancer, breast cancer, genitourinary system carcinomas, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, endocrine system carcinomas, testicular tumor, lung carcinoma, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma. Metastases of the aforementioned cancers can also be treated or prevented in accordance with the methods described herein.

Guidance for determination of a therapeutically effective amount for treatment of cancer may be obtained by reference to in vivo models of the cancer to be treated. For example, the amount of a MMP-9/MMP-2 binding protein that is a therapeutically effective amount in a rodent or Libechov minipig model of cancer may be used to guide the selection of a dose that is a therapeutically effective amount. A number of rodent models of human cancers are available, including nude mouse/tumor xenograft systems (e.g., melanoma xenografts; see, e.g., Trikha et al. Cancer Research 62:2824-2833 (2002)) and murine models of breast cancer or glioma (e.g., Kuperwasser et al., Cancer Research 65, 6130-6138, (2005); Bradford et al., Br J. Neurosurg. 3(2): 197-210 (1989)). A melanoblastoma-bearing Libechov minipig (MeLiM) is available as an animal model of melanoma (e.g., Boisgard et al., Eur J Nucl Med Mol Imaging 30(6):826-34 (2003)).

Synovitis

Synovitis is a condition characterized by inflammation of the synovium, a tissue normally only a few cell layers thick. In synovitis, the synovium can become thickened, more cellular, and engorged with fluid. Synovitis can cause pain and inflammation within the affected joint, and is commonly seen in arthritic conditions (e.g., rheumatoid arthritis).

Active synovial MMP-2 is associated with radiographic erosions in patients with early synovitis (Goldbach-Mansky et al, 2000, Arthritis Res, 2:145-153). Synovial tissue expressions of MMP-2 and TIMP-2 are virtually undetectable in normal synovial tissue samples. The synovial tissue samples of patients with erosive disease have significantly higher levels of active MMP-2 than did those of patients without erosions. This may reflect augmented activation of MMP-2 by increased levels of MMP-9 and low levels of TIMP-2 seen in these tissues. Thus, active MMP-2 can contribute to the development and/or progression of rheumatoid arthritis and osteoarthritis.

Increased levels of MMP-9 have been found in the synovial fluid in subjects with arthritis (compared with normal individuals). The disclosure provides methods of treating (e.g., ameliorating, stabilizing, reducing, or eliminating a symptom of synovitis such as pain, joint swelling, synovial thickening, increased synovial fluid) synovitis by administering a therapeutically effective amount of a MMP-9/MMP-2 binding protein. Also provided are methods which combine MMP-9/MMP-2 binding protein therapy with additional therapies. Current therapies for synovitis include anti-inflammatory medications (e.g. NSAIDS and ibuprofen), cortisone injections into the joint, and surgical treatment (e.g., synovectomy). One or more of these treatments can be used in combination with an MMP-9/MMP-2 binding protein (e.g., an inhibitory MMP-9/MMP-2 binding protein, e.g., an anti-MMP-9/MMP-2 IgG or Fab) to treat this condition.

Guidance for determination of a therapeutically effective amount of an MMP-9/MMP-2 binding protein may be obtained from an animal model of synovitis. Rodent models of synovitis are available, including a rat model of synovitis-like inflammation (Cirino et al., J. Rheumatol. 21(5):824-9 (1994)), and a model of carrageenan synovitis in male Wistar rats (Walsh et al. Lab Invest. 78(12):1513-21 (1998)).

Rheumatoid Arthritis and Associated Conditions

Rheumatoid arthritis (RA) is an autoimmune, chronic inflammatory disease that causes joint swelling and pain and normally results in joint destruction. RA generally follows a relapsing/remitting course, with "flares" of disease activity interspersed with remissions of disease symptoms. RA is associated with a number of additional inflammatory disorders, including Sjogren's syndrome (dry eyes and mouth caused by inflammation of tear and saliva glands), pleuritis (inflammation of the pleura that causes pain upon deep breath and coughing), rheumatoid nodules (nodular sites of inflammation that develop within the lungs), pericarditis (inflammation of the pericardium that causes pain when lying down or leaning forward), Felty syndrome (splenomegaly and leucopenia observed in conjunction with RA, making the subject prone to infection), and vasculitis (an inflammation of the blood vessels which can block blood flow). MMP-2, MMP-9 and MMP-16 have been implicated in rheumatoid arthritis.

Symptoms of active RA include fatigue, lack of appetite, low grade fever, muscle and joint aches, and stiffness. Muscle and joint stiffness are usually most notable in the morning and after periods of inactivity. During flares, joints frequently become red, swollen, painful, and tender, generally as a consequence of synovitis.

Treatment for rheumatoid arthritis involves a combination of medications, rest, joint strengthening exercises, and joint protection. Two classes of medications are used in treating rheumatoid arthritis: anti-inflammatory "first-line drugs," and Disease-Modifying Antirheumatic Drugs (DMARDs)." The first-line drugs, include NSAIDS (e.g., aspirin, naproxen, ibuprofen, and etodolac) and cortisone (corticosteroids). DMARDS, such as gold (e.g., gold salts, gold thioglucose, gold thiomalate, oral gold), methotrexate, sulfasalazine, D-penicillamine, azathioprine, cyclophosphamide, chlorambucil, and cyclosporine, leflunomide, etanercept, infliximab, anakinra, and adalimumab, and hydroxychloroquine, promote disease remission and prevent progressive joint destruction, but they are not anti-inflammatory agents.

Increased levels of MMP-9 have been found in the synovial fluid in subjects with arthritis (compared with normal individuals). The disclosure provides methods of treating (e.g., ameliorating, stabilizing, or eliminating one or more symptoms or ameliorating or stabilizing the subject's score on a RA scale) rheumatoid arthritis by administering a therapeutically effective amount of a MMP-9/MMP-2 binding protein to a subject having or suspected of having RA. Additionally provides are methods of treating RA by administering a therapeutically effective amount of a MMP-9/MMP-2 binding protein and at least one NSAID and/or DMARDS.

Further provided are methods of treating (e.g., ameliorating, stabilizing, or eliminating one or more symptoms) rheumatoid arthritis associated disorders (Sjogren's syndrome, pleuritis, pulmonary rheumatoid nodules, pericarditis, Felty syndrome, and vasculitis) by administering a therapeutically effective amount of an MMP-9/MMP-2 binding protein.

Scales useful for assessing RA and symptoms of RA include the Rheumatoid Arthritis Severity Scale (RASS; Bardwell et al., (2002) *Rheumatology* 41(1):38-45), SF-36 Arthritis Specific Health Index (ASHI; Ware et al., (1999) *Med. Care.* 37(5 Suppl):MS40-50), Arthritis Impact Measurement Scales or Arthritis Impact Measurement Scales 2 (AIMS or AIMS2; Meenan et al. (1992) *Arthritis Rheum.* 35(1):1-10); the Stanford Health Assessment Questionnaire (HAQ), HAQII, or modified HAQ (see, e.g., Pincus et al. (1983) *Arthritis Rheum.* 26(11):1346-53).

Guidance for the determination of the dosage that delivers a therapeutically effective amount of a MMP-9/MMP-2 binding protein may be obtained from animal models of rheumatoid arthritis, such as collagen-induced arthritis (CIA), which is induced, typically in rodents, by immunization with autologous or heterologous type II collagen in adjuvant (Williams et al. Methods Mol. Med. 98:207-16 (2004)).

COPD

Chronic Obstructive Pulmonary Disease (COPD), also known as chronic obstructive airway disease (COAD), is a group of diseases characterized by the pathological limitation of airflow in the airway that is not fully reversible. COPD is the umbrella term for chronic bronchitis, emphysema and a range of other lung disorders. It is most often due to tobacco smoking, but can be due to other airborne irritants such as coal dust, asbestos or solvents, as well as congenital conditions such as alpha-1-antitrypsin deficiency.

The main symptoms of COPD include dyspnea (shortness of breath) lasting for months or perhaps years, possibly accompanied by wheezing, and a persistent cough with sputum production. It is possible the sputum may contain blood (hemoptysis) and become thicker, usually due to damage of the blood vessels of the airways. Severe COPD could lead to cyanosis caused by a lack of oxygen in the blood. In extreme cases it could lead to cor pulmonale due to the extra work required by the heart to get blood to flow through the lungs.

COPD is particularly characterised by the spirometric measurement of a ratio of forced expiratory volume over 1 second ($FEV_1$) to forced vital capacity (FVC) being <0.7 and the $FEV_1$<80% of the predicted value as measured by a plethysmograph. Other signs include a rapid breathing rate (tachypnea) and a wheezing sound heard through a stethoscope. Pulmonary emphysema is NOT the same as subcutaneous emphysema, which is a collection of air under the skin that may be detected by the crepitus sounds produced on palpation.

Treatment for COPD includes inhalers that dilate the airways (bronchodilators) and sometimes theophylline. The COPD patient must stop smoking. In some cases inhaled steroids are used to suppress lung inflammation, and, in severe cases or flare-ups, intravenous or oral steroids are given. Antibiotics are used during flare-ups of symptoms as infections can worsen COPD. Chronic, low-flow oxygen, non-invasive ventilation, or intubation may be needed in some cases. Surgery to remove parts of the disease lung has been shown to be helpful for some patients with COPD. Lung rehabilitation programs may help some patients. Lung transplant is sometimes performed for severe cases. Bronchodilators that can be used include:

There are several types of bronchodilators used clinically with varying efficacy: for example, $\beta_2$ agonists, $M_3$ antimuscarinics, leukotriene antagonists, cromones, corticosteroids, and xanthines. These drugs relax the smooth muscles of the airway allowing for improved airflow. $\beta_2$ agonists include: Salbutamol (Ventolin), Bambuterol, Clenbuterol, Fenoterol, and Formoterol, and long acting $\beta_2$ agonists (LABAs) such as Salmeterol. $M_3$ muscarinic antagonists (anticholinergics) include the quaternary $M_3$ muscarinic antagonist Ipratropium, which is widely prescribed with the $\beta_2$ agonist salbutamol, Ipratropium, and Tiotropium, which can be combined with a LABA and inhaled steroid. Cromones include Cromoglicate and Nedocromil. Leukotriene antagonists can be used and include Montelukast, Pranlukast, Zafirlukast. Xanthines include theophylline, methylxanthines, theobromine. More aggressive EMR interventions include IV $H_1$ antihistamines and IV dexamethasone. Phosphodiesterase-4 antagonists include roflumilast and cilomilast. Corticosteroids can be used and include glucocorticoids, beclomethasone, mometasone, and fluticasone. Corticosteroids are often combined with bronchodilators in a single inhaler. Salmeterol and fluticasone can be combined (Advair). TNF antagonists include cachexin, cachectin infliximab, adalimumab and etanercept.

The disclosure provides methods of treating COPD (e.g., ameliorating symptoms or the worsening of COPD) by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having COPD. Also provided are methods of treating COPD by administering a therapeutically effective amount of a MMP-9/MMP-2 binding protein with another COPD treatment (e.g., $\beta 2$ agonists, $M_3$ antimuscarinics, leukotriene antagonists, cromones, corticosteroids, and xanthines).

Guidance regarding the efficacy and dosage an MMP-9/MMP-2 binding protein which will deliver a therapeutically effective amount of the protein can be obtained from an animal model of COPD, see e.g., PCT publication WO 2007/084486 and references cited therein.

Asthma

Asthma is a chronic condition involving the respiratory system in which the airway occasionally constricts, becomes inflamed, and is lined with excessive amounts of mucus, often in response to one or more triggers. These episodes may be triggered by such things as exposure to an environmental stimulant (or allergen) such as cold air, warm air, moist air, exercise or exertion, or emotional stress. In children, the most common triggers are viral illnesses such as those that cause the common cold. This airway narrowing causes symptoms such as wheezing, shortness of breath, chest tightness, and coughing. The airway constriction responds to bronchodilators.

In some individuals asthma is characterized by chronic respiratory impairment. In others it is an intermittent illness marked by episodic symptoms that may result from a number of triggering events, including upper respiratory infection, stress, airborne allergens, air pollutants (such as smoke or traffic fumes), or exercise. Some or all of the following symptoms may be present in those with asthma: dyspnea, wheezing, stridor, coughing, an inability for physical exertion.

Some asthmatics who have severe shortness of breath and tightening of the lungs never wheeze or have stridor and their symptoms may be confused with a COPD-type disease.

An acute exacerbation of asthma is commonly referred to as an asthma attack. The clinical hallmarks of an attack are shortness of breath (dyspnea) and either wheezing or stridor.

During an asthma episode, inflamed airways react to environmental triggers such as smoke, dust, or pollen. The airways narrow and produce excess mucus, making it difficult to breathe. In essence, asthma is the result of an immune response in the bronchial airways.

The airways of asthmatics are "hypersensitive" to certain triggers/stimuli. In response to exposure to these triggers, the bronchi (large airways) contract into spasm (an "asthma attack"). Inflammation soon follows, leading to a further narrowing of the airways and excessive mucus production, which leads to coughing and other breathing difficulties.

The most effective treatment for asthma is identifying triggers, such as pets or aspirin, and limiting or eliminating exposure to them. Desensitization is currently the only known "cure" to the disease.

Symptomatic control of episodes of wheezing and shortness of breath is generally achieved with fast-acting bronchodilators.

Relief medication: Short-acting, selective $beta_2$-adrenoceptor agonists, such as salbutamol (albuterol USAN), levalbuterol, terbutaline and bitolterol, can be used. Older, less selective adrenergic agonists, such as inhaled epinephrine and ephedrine tablets, can be used. Anticholinergic medications, such as ipratropium bromide may be used.

Preventative medication: Current treatment protocols recommend prevention medications such as an inhaled corticosteroid, which helps to suppress inflammation and reduces the swelling of the lining of the airways, in anyone who has frequent (greater than twice a week) need of relievers or who has severe symptoms. If symptoms persist, additional preventive drugs are added until the asthma is controlled. With the proper use of prevention drugs, asthmatics can avoid the complications that result from overuse of relief medications. Preventive agents include: inhaled glucocorticoids (e.g., ciclesonide, beclomethasone, budesonide, flunisolide, fluticasone, mometasone, and triamcinolone), leukotriene modifiers (e.g., montelukast, zafirlukast, pranlukast, and zileuton), mast cell stabilizers (e.g., cromoglicate (cromolyn), and nedocromil), antimuscarinics/anticholinergics (e.g., ipratropium, oxitropium, and tiotropium), methylxanthines (e.g., theophylline and aminophylline), antihistamines, an IgE blocker such as omalizumab, methotrexate).

Long-acting $beta_2$-adrenoceptor agonists can be used and include salmeterol, formoterol, bambuterol, and sustained-release oral albuterol. Combinations of inhaled steroids and long-acting bronchodilators are becoming more widespread; the most common combination currently in use is fluticasone/salmeterol (Advair in the United States, and Seretide in the United Kingdom). Another combination is budesonide/formoterol which is commercially known as Symbicort.

Concentrations of MMP-9 are increased in the bronchoalveolar lavage fluid (BAL), sputum, bronchi, and serum of asthmatic subjects compared with normal individuals. The disclosure provides methods of treating asthma (e.g., ameliorating symptoms or the worsening of asthma) by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having asthma. Also provided are methods of treating asthma by administering a therapeutically effective amount of a MMP-9/MMP-2 binding protein with another asthma treatment (e.g., glucocorticoids, leukotriene modifiers, mast cell stabilizers, antimuscarinics/anticholinergics, antihistamines, an IgE blocker, methotrexate).

Guidance regarding the efficacy and dosage an MMP-9/MMP-2 binding protein which will deliver a therapeutically effective amount of the protein can be obtained from an animal model of asthma, see e.g., U.S. Pat. No. 5,602,302, or European Pat. No. EP1192944 B1, and references cited therein.

Rhinitis

Rhinitis is the medical term describing irritation and inflammation of some internal areas of the nose. The primary symptom of rhinitis is a runny nose. It is caused by chronic or acute inflammation of the mucous membrane of the nose due to viruses, bacteria or irritants. The inflammation results in the generating of excessive amounts of mucus producing a runny nose, nasal congestion and post-nasal drip. Rhinitis has also been found to adversely affect more than just the nose, throat, and eyes. It has been associated with sleeping problems, problems with the ears, and even been linked to learning problems Rhinitis is caused by an increase in histamine. This increase is likely caused by airborne allergens. These allergens may affect an individual's nose, throat, or eyes and cause an increase in fluid production within these areas. There are two types of Rhinitis that the general population may suffer from: allergic rhinitis and nonallergic rhinitis. Rhinitis is considered IgE-mediated when the sufferer is classified as having allergic rhinitis.

The typical method of diagnosis and monitoring of allergic rhinitis is skin testing, also known as "scratch testing" and "prick testing" due to the series of pricks and/or scratches made into the patient's skin. Small amounts of suspected allergens and/or their extracts (pollen, grass, mite proteins, peanut extract, etc.) are introduced to sites on the skin marked with pen or dye.

The management of rhinitis is mainly medical. Treatment for seasonal rhinitis is only needed during the appropriate time of the year. Current treatments include: antihistamine pills and sprays, leukotriene antagonists, nasal corticosteroid sprays, decongestant pills or sprays, allergen immunotherapy saline irrigation of sinus cavities through the use of a neti pot or by other means; nasal obstruction in perennial rhinitis may be treated by surgery.

The disclosure provides methods of treating rhinitis (e.g., allergic rhinitis) (e.g., ameliorating symptoms or the worsening of rhinitis) by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having rhinitis. Also provided are methods of treating rhinitis by administering a therapeutically effective amount of a MMP-9/MMP-2 binding protein with another rhinitis treatment (e.g., $\beta_2$ agonists, $M_3$ antimuscarinics, leukotriene antagonists, cromones, corticosteroids, and xanthines).

Guidance regarding the efficacy and dosage an MMP-9/MMP-2 binding protein which will deliver a therapeutically effective amount of the protein can be obtained from an animal model of rhinitis, see e.g., Zhao et al. (2005) *Rhinology* 43:47-54, and references cited therein.

IBD

Inflammatory bowel disease (IBD) is a group of inflammatory conditions of the large intestine and, in some cases, the small intestine. The main forms of IBD are Crohn's disease and ulcerative colitis (UC). Accounting for far fewer cases are other forms of IBD: Collagenous colitis, Lymphocytic colitis, Ischaemic colitis, Diversion colitis, Behçet's syndrome, Infective colitis, and Indeterminate colitis.

The main difference between Crohn's disease and UC is the location and nature of the inflammatory changes. Crohn's can affect any part of the gastrointestinal tract, from mouth to anus (skip lesions), although a majority of the cases start in the terminal ileum. Ulcerative colitis, in contrast, is restricted to the colon and the rectum.

Microscopically, ulcerative colitis is restricted to the mucosa (epithelial lining of the gut), while Crohn's disease affects the whole bowel wall.

Finally, Crohn's disease and ulcerative colitis present with extra-intestinal manifestations (such as liver problems, arthritis, skin manifestations and eye problems) in different proportions.

Rarely, a definitive diagnosis of neither Crohn's disease nor ulcerative colitis can be made because of idiosyncrases in the presentation. In this case, a diagnosis of indeterminate colitis may be made.

Diagnosis: Although very different diseases, both may present with any of the following symptoms: abdominal pain, vomiting, diarrhea, hematochezia, weight loss, weight gain and various associated complaints or diseases (arthritis, pyoderma gangrenosum, primary sclerosing cholangitis). Diagnosis is generally by colonoscopy with biopsy of pathological lesions.

Treatment: Depending on the level of severity, IBD may require immunosuppression to control the symptoms. Immunosuppresives such as azathioprine, methotrexate, or 6-mercaptopurine can be used. More commonly, treatment of IBD requires a form of mesalamine. Often, steroids are used to control disease flares and were once acceptable as a maintenance drug. In use for several years in Crohns disease patients and recently in patients with Ulcerative Colitis, biologicals, such as Remicade, have been used. Severe cases may require surgery, such as bowel resection, strictureplasty or a temporary or permanent colostomy or ileostomy. Alternative medicine treatments for bowel disease exist in various forms, however such methods concentrate on controlling underlying pathology in order to avoid prolonged steroidal exposure or surgical excisement.

Usually the treatment is started by administering drugs, such as Prednisone, with high anti-inflammatory affects. Once the inflammation is successfully controlled, the patient is usually switched to a lighter drug, such as Asacol-a mesalamine, to keep the disease in remission. If unsuccessful, a combination of the aforementioned immunosurpression drugs with a mesalamine (which may also have an anti-inflammatory effect) may or may not be administered, depending on the patient.

The disclosure provides methods of treating IBD (e.g., ameliorating symptoms or the worsening of IBD) by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having IBD. Also provided are methods of treating IBD by administering a therapeutically effective amount of a MMP-9/MMP-2 binding protein with another IBD treatment (e.g., azathioprine, methotrexate, 6-mercaptopurine, a mesalamine, Remicade).

Guidance regarding the efficacy and dosage an MMP-9/MMP-2 binding protein which will deliver a therapeutically effective amount of the protein can be obtained from animal models of IBD, see e.g., those described in U.S. Pat. No. 6,114,382, PCT publication WO 2004/071186 and references cited therein.

Ocular Conditions

Macular Degeneration. Macular degeneration progressively destroys the macula, the central portion of the retina, impairing central vision, leading to difficulty with reading, driving, and/or other daily activities that require fine central vision. While there are a number of different forms of macular degeneration, the most common is age-related macular degeneration (AMD). AMD presents as either "dry" or "wet", with the wet type being far more common. In wet AMD, fluid leaking from newly formed subretinal blood vessels (subretinal neovascularization) distorts the macula and impairs vision. Symptoms of AMD include loss or impairment in central vision (generally slowing in dry AMD and rapidly in wet AMD) and abnormal visual perception of straight lines (e.g., straight lines appear wavy). Supplements of zinc and the antioxidants vitamin C, vitamin E and beta-carotene reportedly slow the progression of wet AMD.

The disclosure provides methods of treating (e.g., ameliorating vision, stabilizing vision degradation, or reducing the rate of vision degradation) AMD (wet AMD or dry AMD) by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having AMD. Also provided are methods of treating AMD by administering a therapeutically effective amount of a MMP-9/MMP-2 binding protein with another AMD treatment (e.g., zinc, vitamin C, vitamin E and/or beta-carotene).

Guidance regarding the efficacy and dosage an MMP-9/MMP-2 binding protein which will deliver a therapeutically effective amount of the protein can be obtained from an animal model of macular degeneration, e.g., a *Coturnix coturnix* japonica (Japanese quail) model of macular degeneration (U.S. Pat. No. 5,854,015), or wound creation on the Bruch's membrane of a C57BL/6J mouse, e.g., with a krypton laser (US App. No. 20030181531).

Corneal Disease. Keratoconus is a progressive disease where the cornea thins and changes shape. The resulting distortion (astigmatism) frequently causes nearsightedness. Keratoconus may also cause swelling and scarring of the cornea and vision loss.

The disclosure provides methods of treating (e.g., improving or stabilizing vision, or improving, stabilizing, reducing eliminating, or preventing corneal scarring) keratoconus in a subject having or suspected of having keratoconus by administering an effective amount of a MMP-9/MMP-2 binding protein (e.g., an inhibitory MMP-9/MMP-2 binding protein, e.g., an anti-MMP-9/MMP-2 IgG or Fab).

Guidance regarding the efficacy and dosage an MMP-9/MMP-2 binding protein which will deliver a therapeutically effective amount of the protein can be obtained from an animal model of keratoconus, e.g., the inbred SKC mouse line, which serves as a model for a subset of keratoconus (Tachibana et al. Investig Opthalmol Visual Sci, 43:51-57 (2002)).

Corneal Infection. Also provided are methods of treating (e.g., preventing, reducing, stabilizing or eliminating corneal scarring as a result of the infection) corneal infection by administering an effective amount of a MMP-9?MMP-2 binding protein (e.g., an inhibitory MMP-9/MMP-2 binding protein, e.g., an anti-MMP-9/MMP-2 IgG or Fab) to a subject having or suspected of having a corneal infection. Additionally, methods are provided for treatment of corneal infection by administering a MMP-9/MMP-2 binding protein and a therapeutic agent which treats the infectious agent (e.g., an antibiotic or anti-viral agent).

Guidance regarding the efficacy and dosage an MMP-9/MMP-2 binding protein which will deliver a therapeutically effective amount of the protein can be obtained from an animal model of corneal infection, e.g., a rabbit model of experimental keratomycosis, in which keratitis is induced with a standardized inoculum of *Candida albicans* (SC 5314) placed on a debrided cornea (Goldblum et al. Antimicrob Agents Chemother 49:1359-1363 (2005)).

Osteoarthritis

Osteoarthritis, also known as degenerative arthritis, is characterized by the breakdown and eventual loss of the cartilage of one or more joints. Osteoarthritis commonly affects the hands, feet, spine, and large weight-bearing joints, such as the hips and knees. The disclosure provides methods of treating (e.g., stabilizing, reducing, or eliminating joint pain, stabilizing or improving performance on general health or osteoarthritis scales) osteoarthritis by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having osteoarthritis.

Current medical treatment of osteoarthritis includes conservative measures (e.g., rest, weight reduction, physical and occupational therapy) and medications such as acetaminophen, pain-relieving creams applied to the skin over the joints such as capsaicin, salycin, methyl salicylate, and menthol, nonsteroidal anti-inflammatory drugs (NSAIDs) such as aspirin, ibuprofen, nabumetone, and naproxen, and Cox-2 inhibitors. The disclosure further provides methods of treating osteoarthritis by administering a therapeutically effective amount of a MMP-9/MMP-2 binding protein (e.g., an inhibitory MMP-9/MMP-2 binding protein, e.g., an anti-MMP-9/MMP-2 IgG or Fab) and another osteoarthritis therapy (e.g. acetaminophen, a topical pain-relieving cream, a nonsteroidal anti-inflammatory drug (NSAID) such as aspirin, ibuprofen, nabumetone, or naproxen, or a Cox-2 inhibitor).

Scales useful for the assessment of osteoarthritis include the Knee Injury and Osteoarthritis Outcome Score (KOOS; Roos et al. (1998) *J. Orthop. Sports Phys. Ther.* 28(2):88-96), Western Ontario and McMaster Universities Osteoarthrtis Index (WOMAC; Roos et al. (2003) *Health Qual. Life Outcomes* 1(1):17), and the 36-item Short Form General Health Scale (SF-36 GHS), as well as other assessment tools known in the art.

Guidance regarding the efficacy and dosage an MMP-9/MMP-2 binding protein which will deliver a therapeutically effective amount of the protein can be obtained from an animal model of osteoarthritis, e.g., injection of mono-iodoacetate (MIA) into the femorotibial joint of rodents which promotes loss of articular cartilage similar to that noted in human osteoarthritis (Guzman et al. Toxicol Pathol. 31(6): 619-24 (2003)), or transection of the anterior cruciate ligament (ACL) in canines to induce osteoarthritis (Fife and Brandt J Clin Invest. 84(5): 1432-1439 (1989)).

Heart Failure

Heart failure is caused by any condition which reduces the efficiency of the myocardium, or heart muscle, through damage or overloading. As such, it can be caused by as diverse an array of conditions as myocardial infarction, hypertension and amyloidosis. Over time these increases in workload will produce changes to the heart itself. Congestive heart failure (CHF), congestive cardiac failure (CCF) or just heart failure, is a condition that can result from any structural or functional cardiac disorder that impairs the ability of the heart to fill with or pump a sufficient amount of blood through the body.

Other related terms include ischemic cardiomyopathy (implying that the cause of heart failure is coronary artery disease) and dilated cardiomyopathy (which is a description of echocardiographic findings characteristic of heart failure but which does not suggest any specific etiology).

Congestive heart failure exacerbation or decompensated heart failure (DHF) refer to episodes in which a patient with known chronic heart failure acutely develops symptoms.

Symptoms are dependent on two factors. The first is based on the side of the heart, right or left, that is involved. The second factor is based on the type of failure, either diastolic or systolic. Symptoms and presentation may be indistinguishable making diagnosis impossible based on symptoms.

Given that the left side of the heart pumps blood from the lungs to the organs, failure to do so leads to congestion of the lung veins and symptoms that reflect this, as well as reduced supply of blood to the tissues. The predominant respiratory symptom is shortness of breath on exertion (dyspnea, dyspnée d'effort)—or in severe cases at rest—and easy fatigueability. Orthopnea is increasing breathlessness on reclining. Paroxysmal nocturnal dyspnea is a nighttime attack of severe breathlessness, usually several hours after going to sleep. Poor circulation to the body leads to dizziness, confusion and diaphoresis and cool extremities at rest.

The right side of the heart pumps blood returned from the tissues to the lungs to exchange $CO_2$ for $O_2$. Hence, failure of the right side leads to congestion of peripheral tissues. This may lead to peripheral edema or anasarca and nocturia. In more severe cases, ascites and hepatomegaly may develop.

Heart failure may decompensate easily; this may occur as the result of any intercurrent illness (such as pneumonia), but specifically myocardial infarction, anaemia, hyperthyroidism or arrhythmias. These place additional strain on the heart muscle, which may cause symptoms to rapidly worsen. Excessive fluid or salt intake (including intravenous fluids for unrelated indications, but more commonly from dietary indiscretion), and medication that causes fluid retention (such as NSAIDs and thiazolidinediones), may also precipitate decompensation.

In examining a patient with possible heart failure, a health professional would look for particular signs. General signs indicating heart failure are a laterally displaced apex beat (as the heart is enlarged) and a gallop rhythm (additional heart sounds) in case of decompensation. Heart murmurs may indicate the presence of valvular heart disease, either as a cause (e.g. aortic stenosis) or as a result (e.g. mitral regurgitation) of the heart failure.

Predominant left-sided clinical signs are tachypnea and increased work of breathing (signs of respiratory distress not specific to heart failure), rales or crackles, which suggests the development of pulmonary edema, dullness of the lung fields to percussion and diminished breath sounds at the bases of the lung, which suggests the development of a pleural effusion (fluid collection in the pleural cavity) that is transudative in nature, and cyanosis which suggests hypoxemia, caused by the decreased rate of diffusion of oxygen from fluid-filled alveoli to the pulmonary capillaries.

Right-sided signs are peripheral edema, ascites and hepatomegaly, an increased jugular venous pressure, which can be increased further by the hepatojugular reflux, and a parasternal heave.

Causes of left-side heart failure include: hypertension (high blood pressure), aortic and mitral valve disease, aortic coarctation. Causes of right-side heart failure include pulmonary hypertension (e.g. due to chronic lung disease), pulmonary or tricuspid valve disease. Causes of both types include: Ischemic heart disease (due to insufficient vascular supply, usually as a result of coronary artery disease); this may be chronic or due to acute myocardial infarction (a heart attack), chronic arrhythmias (e.g. atrial fibrillation), cardiomyopathy of any cause, cardiac fibrosis, chronic severe anemia, thyroid disease (hyperthyroidism and hypothyroidism).

Treatments of heart failure include: moderate physical activity, bed rest, weight reduction, monitoring weight, sodium restriction, fluid restriction, diuretic agents, vasodilator agents, positive inotropes, ACE inhibitors, beta blockers, and aldosterone antagonists (e.g., spironolactone), angiotensin II receptor antagonist therapy (also referred to as $AT_1$-antagonists or angiotensin receptor blockers) (particularly using candesartan). Diuretics include loop diuretics (e.g., furosemide, bumetanide), thiazide diuretics (e.g., hydrochlorothiazide, chlorthalidone, chlorthiazide), potassium-sparing diuretics (e.g., amiloride), spironolactone, eplerenone. Beta blockers include bisoprolol, carvedilol, and extended-release metoprolol. Positive inotropes include digoxin, dobutamine. Phosphodiesterase inhibitors such as milrinone are sometimes utilized in severe cardiomyopathy. Alternative vasodilators include the combination of isosorbide dinitrate/hydralazine. Aldosterone receptor antagonists include spironolactone and the related drug eplerenone. Recombinant neuroendocrine hormones can also be used and include Nesiritide, a recombinant form of B-natriuretic peptide. Vasopressin receptor antagonists that can be used include tolvaptan and conivaptan. Devices and surgery options include cardiac resynchronization therapy (CRT; pacing both the left and right ventricles), through implantation of an bi-ventricular pacemaker, or surgical remodelling of the heart, an implantable cardioverter-defibrillator (ICD), left ventricular assist devices (LVADs).

The disclosure provides methods of treating heart failure (e.g., ameliorating symptoms or the worsening of heart failure) by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having heart failure. Also provided are methods of treating heart failure by administering a therapeutically effective amount of a MMP-9/MMP-2 binding protein with another heart failure treatment (e.g., a diuretic agent, a vasodilator agent, a positive inotrope, an ACE inhibitor, a beta blocker, and an aldosterone antagonist (e.g., spironolactone), angiotensin II receptor antagonist therapy (also referred to as $AT_1$-antagonists or angiotensin receptor blockers)).

Guidance regarding the efficacy and dosage an MMP-9/MMP-2 binding protein which will deliver a therapeutically effective amount of the protein can be obtained from an animal model of heart failure, see e.g., U.S. Pat. No. 7,166,762 and references cited therein.

Septic Shock

Septic shock is a serious medical condition caused by decreased tissue perfusion and oxygen delivery as a result of infection and sepsis. It can cause multiple organ failure and death. Its most common victims are children, immunocompromised individuals, and the elderly, as their immune systems cannot cope with the infection as well as healthy adults are able. The mortality rate from septic shock is approximately 50%.

Symptoms include: Refractory hypotension—hypotension despite adequate fluid resuscitation. In adults it is defined as a systolic blood pressure <90 mmHg, or a MAP <60 mmHg, without the requirement for inotropic support, or a reduction of 40 mmHg in the systolic blood pressure from baseline. In children, it is BP <2 SD of the normal blood pressure. In addition to the two criteria above, two or more of the following can be present: Hyperventilation (high respiratory rate) >20 breaths per minute or, on blood gas, a $P_aCO_2$ less than 32 mmHg, and/or White blood cell count <4000 cells/mm$^3$ or >12000 cells/mm$^3$ (<4×10$^9$ or >12×10$^9$ cells/L).

A subclass of distributive shock, shock refers specifically to decreased tissue perfusion resulting in end-organ dysfunction. Cytokines TNFα, IL-1β, IL-6 released in a large scale inflammatory response results in massive vasodilation, increased capillary permeability, decreased systemic vascular resistance, and hypotension. Hypotension reduces tissue perfusion pressure and thus tissue hypoxia ensues. Finally, in an attempt to offset decreased blood pressure, ventricular dilatation and myocardial dysfunction will occur.

The process of infection by bacteria or fungi can result in systemic signs and symptoms that are variously described. In rough order of severity, these are bacteremia or fungemia; septicemia; sepsis, severe sepsis or sepsis syndrome; septic shock; refractory septic shock; multiple organ dysfunction syndrome, and death.

The condition develops as a response to certain microbial molecules which trigger the production and release of cellular mediators, such as tumor necrosis factors (TNF); these act to stimulate immune response. Besides TNFα, other cytokines involved in the development of septic shock include interleukin-1β, and interferon γ.

Treatment primarily consists of 1) Volume resuscitation 2) Early antibiotic administration 3) Rapid source identification and control and 4) Support of major organ dysfunction. Among the choices for pressors, norepinephrine (optionally plus dobutamine as needed for cardiac output) or epinephrine can be used. Antimmediator agents may be of some limited use in severe clinical situations: Corticosteroids, especially if combined with a mineralocorticoid, can reduce mortality among patients who have relative adrenal insufficiency; or recombinant activated protein C (drotrecogin alpha). A sophorolipid mixture can be used.

The disclosure provides methods of treating septic shock by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having septic shock. Also provided are methods of treating septic shock by administering a therapeutically effective amount of a MMP-9/MMP-2 binding protein with another septic shock treatment (e.g., corticosteroid, sophorolipid mixture, or antibiotics).

Guidance regarding the efficacy and dosage an MMP-9/MMP-2 binding protein which will deliver a therapeutically effective amount of the protein can be obtained from an animal model of septic shock, see e.g., U.S. Pat. No. 7,262,178, and references cited therein.

Neuropathic Pain

Neuropathic pain is a complex, chronic pain state that usually is accompanied by tissue injury. With neuropathic pain, the nerve fibers themselves might be damaged, dysfunctional, or injured. These damaged nerve fibers send incorrect signals to other pain centers. The impact of a nerve fiber injury includes a change in nerve function both at the site of injury and areas around the injury.

Neuropathic pain often seems to have no obvious cause. It responds poorly to standard pain treatment and occasionally might get worse instead of better over time. For some people, it can lead to serious disability. One example of neuropathic pain is called phantom limb syndrome. This occurs when an arm or a leg has been removed because of illness or injury, but the brain still gets pain messages from the nerves that originally carried impulses from the missing limb. These nerves now seem to misfire and cause pain. Some common causes of neuropathic pain include: alcoholism, amputation, back, leg, and hip problems, cancer chemotherapy, diabetes, facial nerve problems, HIV infection or AIDS, multiple sclerosis, shingles, and spine surgery.

Some symptoms of neuropathic pain include shooting pain, burning pain, tingling, and numbness.

Improvement is often possible with proper treatment. Treatments include: administering an NSAID, an analgesic (e.g., with morphine), an anticonvulsant drug (e.g., an anticonvulsant described in U.S. Pat. No. 5,760,007), an antidepressant drug, or other pain reliever. If another condition, such as diabetes, is involved, better management of that disorder might alleviate the neuropathic pain. In cases that are difficult to treat, a pain specialist might use invasive or implantable device therapies to effectively manage the pain. Electrical stimulation of the nerves involved in neuropathic pain generation might significantly control the pain symptoms.

MMP-9 and MMP-2 have been found to play roles in the development of neuropathic pain. MMP-9 is upregulated in the early phase of neuropathic pain development, while MMP-2 is upregulated in the late phase of neuropathic pain development. Targeting and inhibition of MMP-9 and/or MMP-2 is a therapeutic approach to treating neuropathic pain. The disclosure provides methods of treating neuropathic pain by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having neuropathic pain. Also provided are methods of treating neuropathic pain by administering a therapeutically effective amount of a MMP-9/MMP-2 binding protein with another neuropathic pain treatment (e.g., an NSAID, an analgesic (e.g., with morphine), an anticonvulsant drug, an antidepressant drug, or other pain reliever; invasive or implantable device therapies).

Guidance regarding the efficacy and dosage an MMP-9/MMP-2 binding protein which will deliver a therapeutically effective amount of the protein can be obtained from an animal model of neuropathic pain, such as the L5 spinal nerve ligation (SNL) animal model, see e.g., Kawasaki et al., Feb. 10, 2008, *Nat. Med.* advance on-line publication doi:10.1038/nm1723. See also U.S. Pat. No. 5,760,007 and references cited therein.

Endometriosis

Endometriosis is a common medical condition characterized by growth beyond or outside the uterus of endometrium, the tissue that normally lines the uterus. In endometriosis, the endometrium is found to be growing outside the uterus, on or in other areas of the body. Normally, the endometrium is shed each month during the menstrual cycle; however, in endometriosis, the misplaced endometrium is usually unable to exit the body. The endometriotic tissues still detach and bleed, but the result is far different: internal bleeding, degenerated blood and tissue shedding, inflammation of the surrounding areas, pain, and formation of scar tissue may result. In addition, depending on the location of the growths, interference with the normal function of the bowel, bladder, small intestines and other organs within the pelvic cavity can occur. In very rare cases, endometriosis has also been found in the skin, the lungs, the eye, the diaphragm, and the brain.

A major symptom of endometriosis is severe recurring pain. The amount of pain a woman feels is not necessarily related to the extent or stage (1 through 4) of endometriosis. Some women will have little or no pain despite having extensive endometriosis affecting large areas or having endometriosis with scarring. On the other hand, women may have severe pain even though they have only a few small areas of endometriosis.

Symptoms of endometriosis can include (but are not limited to): Painful, sometimes disabling menstrual cramps (dysmenorrhea), pain may get worse over time (progressive pain), chronic pain (typically lower back pain and pelvic pain, also abdominal), painful sex (dyspareunia), painful bowel movements (dyschezia) or painful urination (dysuria), heavy menstrual periods (menorrhagia), nausea and vomiting, premenstrual or intermenstrual spotting (bleeding between periods), and infertility and subfertility. Endometriosis may lead to fallopian tube obstruction. Bowel obstruction (possibly including vomiting, crampy pain, diarrhea, a rigid and tender abdomen, and distention of the abdomen, depending on where the blockage is and what is causing it) or complete urinary retention. In addition, women who are diagnosed with endometriosis may have gastrointestinal symptoms that may mimic irritable bowel syndrome, as well as fatigue.

Patients who rupture an endometriotic cyst may present with an acute abdomen as a medical emergency. Endometriotic cysts in the thoracic cavity may cause some form of thoracic endometriosis syndrome, most often catamenial pneumothorax.

Diagnosis. Health history and a physical examination can in many patients lead the physician to suspect the diagnosis. Use of imaging tests (e.g., ultrasound and magnetic resonance imaging (MRI)) may identify larger endometriotic areas, such as nodules or endometriotic cysts. The only sure way to confirm an endometriosis diagnosis is by laparoscopy. The diagnosis is based on the characteristic appearance of the disease, if necessary corroborated by a biopsy. Laparoscopy also allows for surgical treatment of endometriosis.

Treatment. Generally, endometriosis-directed drug therapy (other than the oral contraceptive pill) is utilized after a confirmed surgical diagnosis of endometriosis. Treatments include: NSAIDs and other pain medication, commonly used in conjunction with other therapy; Gonadotropin Releasing Hormone (GnRH) Agonist; Hormone suppression therapy; Progesterone or Progestins; avoiding products with xenoestrogens, which have a similar effect to naturally produced estrogen and can increase growth of the endometrium; continuous hormonal contraception; suppressive steroids such as Danazol (Danocrine) and gestrinone; aromatase inhibitors. Surgical treatment is usually a good choice if endometriosis is extensive, or very painful. Surgical treatments range from minor to major surgical procedures. Laparoscopy is very useful not only to diagnose endometriosis, but to treat it—endometriotic tissue can be ablated or removed in an attempt to restore normal anatomy. Laparotomy can be used for more extensive surgery either in attempt to restore normal anatomy. Other procedures include hysterectomy, bilateral salpingo-oophorectomy (removal of the fallopian tubes and ovaries), bowel resection. For patients with extreme pain, a presacral neurectomy may be indicated where the nerves to the uterus are cut.

MMP-9 is upregulated in endometriosis and may contribute to survival and invasion of endometriosis. The disclosure provides methods of treating endometriosis by administering a therapeutically effective amount of a MMP-9/MMP-2 binding protein (e.g., an inhibitory MMP-9/MMP-2 binding protein, e.g., an anti-MMP-9/MMP-2 IgG or Fab) to a subject having or suspected of having endometriosis. Also provided are methods of treating endometriosis by administering a therapeutically effective amount of a MMP-9/MMP-2 binding protein with another endometriosis treatment (e.g., corticosteroid, sophorolipid mixture, or antibiotics).

Guidance regarding the efficacy and dosage an MMP-9/MMP-2 binding protein which will deliver a therapeutically effective amount of the protein can be obtained from an animal model of endometriosis, see e.g., U.S. Pat. Nos. 6,429, 353 and 7,220,890, and references cited therein.

Combination Therapies

The MMP-9/MMP-2 binding proteins described herein, e.g., anti-MMP-9/MMP-2 Fabs or IgGs, can be administered in combination with one or more of the other therapies for treating a disease or condition associated with MMP-9 activity and/or MMP-2 activity, e.g., a disease or condition described herein. For example, an MMP-9/MMP-2 binding protein can be used therapeutically or prophylactically with surgery, another MMP-9 inhibitor (e.g., a small molecule inhibitor, another anti-MMP-9 Fab or IgG (e.g., another Fab or IgG described herein), peptide inhibitor, or small molecule inhibitor), another anti-MMP-9 binding protein (e.g., IgG or Fab, e.g., 539A-M0166-F10 or a protein containing one or more heavy and/or light chains CDRs thereof, or 539A-M0240-B03 or a protein containing one or more heavy and/or light chains CDRs thereof, or another Fab or IgG described herein), an anti-MMP14 binding protein (e.g., IgG or Fab, e.g., DX-2400, or a protein described in U.S. Pub. App. No. 2007-0217997), or another MMP-2 inhibitor (another MMP-2 inhibitor, e.g., a small molecule inhibitor, another anti-MMP-2 Fab or IgG (e.g., another Fab or IgG described herein), peptide inhibitor, or small molecule inhibitor). Examples of other MMP-9 inhibitors and MMP-2 inhibitors that can be used in combination therapy with an MMP-9/MMP-2 binding protein described herein are provided herein.

One or more small-molecule MMP inhibitors can be used in combination with one or more MMP-9/MMP-2 binding proteins described herein. For example, the combination can result in a lower dose of the small-molecule inhibitor being needed, such that side effects are reduced.

The MMP-9/MMP-2 binding proteins described herein can be administered in combination with one or more of the other therapies for treating cancers, including, but not limited to: surgery; radiation therapy, and chemotherapy. For example, proteins that inhibit MMP-9, MMP-2 or that inhibit a downstream event of MMP-9 activity or MMP-2 activity can also be used in combination with other anti-cancer therapies, such as radiation therapy, chemotherapy, surgery, or administration of a second agent. For example, the second agent can be a Tie-1 inhibitor (e.g., Tie-1 binding proteins; see e.g., U.S. Ser. No. 11/199,739 and PCT/US2005/0284, both filed Aug. 9, 2005). As another example, the second agent can be an anti-MMP14 binding protein (e.g., IgG or Fab, e.g., DX-2400, or a protein described in U.S. Pub. App. No. 2007-0217997). As another example, the second agent can be one that targets or negatively regulates the VEGF signaling pathway. Examples of this latter class include VEGF antagonists (e.g., anti-VEGF antibodies such as bevacizumab) and VEGF receptor antagonists (e.g., anti-VEGF receptor antibodies). One particularly preferred combination includes bevacizumab. As a further example, the second agent is an inhibitor of plasmin, such as a kunitz domain-containing protein or polypeptide (e.g., a plasmin-inhibiting kunitz domain disclosed in U.S. Pat. No. 6,010,880, such as a protein or polypeptide comprising the amino acid sequence MHSFCAFKAETGPCRARFDRWFFNIFTRQ-CEEFIYGGCEGNQNRFESLEECKKMCTRD (SEQ ID NO:1)). As another example, the second agent is an agent that binds to Her2, such as a Her2-binding antibody (e.g., trastuzumab). The combination can further include 5-FU and leucovorin, and/or irinotecan.

Inhibitors of MMP-9 and MMP-2 (e.g., the MMP-9/MMP-2 binding proteins disclosed herein) can potentiate the activity of an agent that targets Her2 (e.g., a Her2-binding antibody such as trastuzumab). Accordingly, in one combination therapy for the treatment of breast cancer, the second therapy is an agent that binds Her2, such as a Her2-binding antibody (e.g., trastuzumab). When an MMP-9/MMP-2 binding protein is used in a combination therapy with a Her2 binding agent, the dose of the Her2 binding agent may be reduced from the dose of the Her2 binding agent when administered not in combination with an MMP-9/MMP-2 binding protein (e.g., is at least 10%, 25%, 40%, or 50% less than the dose of the Her2 binding agent when administered not in combination with a MMP-9/MMP-2 binding protein). For example, the dose of trastuzumab, when administered in a combination therapy with an MMP-9/MMP-2 binding protein is less than about 4.0, 3.6, 3.0, 2.4, or 2 mg/kg as an initial (loading) dose, and less than about 2.0, 1.8, 1.5, 1.2, or 1 mg/kg in subsequent doses.

The MMP-9/MMP-2 binding proteins described herein can also be administered in combination with one or more other therapies for treating ocular disorders, such as surgical or medical (e.g., administration of a second agent) therapies. For example, in treatment of age-related macular degeneration (e.g., wet age-related macular degeneration), an MMP-9/MMP-2 binding protein may be administered in conjunction with (e.g., before, during, or after) laser surgery (laser photocoagulation or photocoagulation therapy). As another example, the MMP-9/MMP-2 binding protein can be administered in combination with a second agent, such as a VEGF antagonist (e.g., an anti-VEGF antibody such as bevacizumab or ranibizumab) or a VEGF receptor antagonist (e.g., anti-VEGF receptor antibodies).

The term "combination" refers to the use of the two or more agents or therapies to treat the same patient, wherein the use or action of the agents or therapies overlap in time. The agents or therapies can be administered at the same time (e.g., as a single formulation that is administered to a patient or as two separate formulations administered concurrently) or sequentially in any order. Sequential administrations are administrations that are given at different times. The time between administration of the one agent and another agent can be minutes, hours, days, or weeks. The use of an MMP-9/MMP-2 binding protein described herein can also be used to reduce the dosage of another therapy, e.g., to reduce the side-effects associated with another agent that is being administered, e.g., to reduce the side-effects of an anti-VEGF antibody such as bevacizumab. Accordingly, a combination can include administering a second agent at a dosage at least 10, 20, 30, or 50% lower than would be used in the absence of the MMP-9/MMP-2 binding protein.

In addition, a subject can be treated for an angiogenesis-associated disorder, e.g., a cancer, by administering to the subject a first and second agent. For example, the first agent modulates early stage angiogenesis and the second agent modulates a subsequent stage of angiogenesis or also modulates early stage angiogenesis. The first and second agents can be administered using a single pharmaceutical composition or can be administered separately. In one embodiment, the first agent is a VEGF pathway antagonist (e.g., an inhibitor of a VEGF (e.g., VEGF-A, -B, or -C) or a VEGF receptor (e.g., KDR or VEGF receptor III (Flt4)) or a bFGF pathway antagonist (e.g., an antibody that binds to bFGF or a bFGF receptor). Other VEGF pathway antagonists are also described, herein and elsewhere. In one embodiment, the second agent inhibits or decreases the mobility or invasiveness of tumor cells. For example, the second agent comprises an MMP-9/MMP-2 binding protein. For example, the second agent is an MMP-9/MMP-2 binding protein described herein.

Once a tumor reaches a certain size (e.g., ~1-2 mm), the tumor requires new vasculature prior to increasing its mass. An early stage of tumor angiogenesis can include a signal from the tumor, e.g., secretion of VEGF, to stimulate the growth of new blood vessels from the host and infiltration of the tumor by the vessels. VEGF can, for example, stimulate proliferation of endothelial cells that are then assembled into blood vessels. A late stage of tumor growth can include metastasis, mobility and invasiveness of tumor cells. This mobility and invasiveness may involve the action of matrix metalloproteinases, e.g., MMP-2 or MMP-9. Thus, an effective therapy to treat angiogenesis-related disorders can involve a combination of an agent that modulates an early stage angiogenesis (e.g., VEGF pathway antagonists, e.g., anti-VEGF (e.g., bevacizumab) or anti-VEGF receptor (e.g., anti-KDR) antibodies; or antagonists of other pro-angiogenic pathways, e.g., anti-bFGF antibodies or anti-bFGF receptor (e.g., anti-bFGF receptor-1, -2, -3) antibodies) and an agent that modulates a late stage of tumor growth can include metastasis, mobility and invasiveness of tumor cells s (e.g., antagonists of MMP-9 and MMP2 (e.g., anti-MMP-9/MMP-2 antibodies (e.g., an antibody disclosed herein)). One or more of these agents can be used in combination. One or more of these agents may also be used in combination with other anti-cancer therapies, such as radiation therapy or chemotherapy.

Exemplary VEGF receptor antagonists include inhibitors of a VEGF (e.g., VEGF-A, -B, or -C, for example bevacizumab), modulators of VEGF expression (e.g., INGN-241, oral tetrathiomolybdate, 2-methoxyestradiol, 2-methoxyestradiol nanocrystal dispersion, bevasiranib sodium, PTC-299, Veglin), inhibitors of a VEGF receptor (e.g., KDR or VEGF receptor III (Flt4), for example anti-KDR antibodies, VEGFR2 antibodies such as CDP-791, IMC-1121B, VEGFR2 blockers such as CT-322), VEGFR3 antibodies such as mF4-31C1 from Imclone Systems, modulators of VEGFR expression (e.g., VEGFR1 expression modulator Sirna-027) or inhibitors of VEGF receptor downstream signaling.

Exemplary inhibitors of VEGF include bevacizumab, pegaptanib, ranibizumab, NEOVASTAT®, AE-941, VEGF Trap, and PI-88.

Exemplary VEGF receptor antagonists include inhibitors of VEGF receptor tyrosine kinase activity. 4-[4-(1-Amino-1-methylethyl)phenyl]-2-[4-(2-morpholin-4-yl-ethyl)phenylamino]pyrimidine-5-carbonitrile (JNJ-17029259) is one of a structural class of 5-cyanopyrimidines that are orally available, selective, nanomolar inhibitors of the vascular endothelial growth factor receptor-2 (VEGF-R2). Additional examples include: PTK-787/ZK222584(Astra-Zeneca), SU5416, SU11248 (Pfizer), and ZD6474 ([N-(4-bromo-2-fluorophenyl)-6-methoxy-7-[(1-methylpiperidin-4-yl)methoxy]quinazolin-4-amine]), vandetanib, cediranib, AG-013958, CP-547632, E-7080, XL-184, L-21649, and ZK-304709. Other VEGF antagonist agents are broad specificity tyrosine kinase inhibitors, e.g., SU6668 (see, e.g., Bergers, B. et al., 2003 J. Clin. Invest. 111:1287-95), sorafenib, sunitinib, pazopanib, vatalanib, AEE-788, AMG-706, axitinib, BIBF-1120, SU-14813, XL-647, XL-999, ABT-869, BAY-57-9352, BAY-73-4506, BMS-582664, CEP-7055, CHIR-265, OSI-930, and TKI-258. Also useful are agents that down regulate VEGF receptors on the cell surface, such as fenretinide, and agents which inhibit VEGF receptor downstream signaling, such as squalamine The second agent or therapy can also be another anti-cancer agent or therapy. Non-limiting examples of anti-cancer agents include, e.g., anti-microtubule agents, topoisomerase inhibitors, antimetabolites, mitotic inhibitors, alkylating agents, intercalating agents, agents capable of interfering with a signal transduction pathway, agents that promote apoptosis, radiation, and antibodies against other tumor-associated antigens (including naked antibodies, immunotoxins and radioconjugates). Examples of the particular classes of anti-cancer agents are provided in detail as follows: antitubulin/antimicrotubule, e.g., paclitaxel, vincristine, vinblastine, vindesine, vinorelbin, taxotere; topoisomerase I inhibitors, e.g., irinotecan, topotecan, camptothecin, doxorubicin, etoposide, mitoxantrone, daunorubicin, idarubicin, teniposide, amsacrine, epirubicin, merbarone, piroxantrone hydrochloride; antimetabolites, e.g., 5 fluorouracil (5 FU), methotrexate, 6 mercaptopurine, 6 thioguanine, fludarabine phosphate, cytarabine/Ara C, trimetrexate, gemcitabine, acivicin, alanosine, pyrazofurin, N-Phosphoracetyl-L-Asparate=PALA, pentostatin, 5 azacitidine, 5 Aza 2' deoxycytidine, ara A, cladribine, 5 fluorouridine, FUDR, tiazofurin, N-[5-[N-(3,4-dihydro-2-methyl-4-oxoquinazolin-6-ylmethyl)-N-methylamino]-2-thenoyl]-L-glutamic acid; alkylating agents, e.g., cisplatin, carboplatin, mitomycin C, BCNU=Carmustine, melphalan, thiotepa, busulfan, chlorambucil, plicamycin, dacarbazine, ifosfamide phosphate, cyclophosphamide, nitrogen mustard, uracil mustard, pipobroman, 4 ipomeanol; agents acting via other mechanisms of action, e.g., dihydrolenperone, spiromustine, and desipeptide; biological response modifiers, e.g., to enhance anti-tumor responses, such as interferon; apoptotic agents, such as actinomycin D; and anti-hormones, for example anti-estrogens such as tamoxifen or, for example antiandrogens such as 4'-cyano-3-(4-fluorophenylsulphonyl)-2-hydroxy-2-methyl-3'-(trifluoromethyl)propionanilide.

A combination therapy can include administering an agent that reduces the side effects of other therapies. The agent can be an agent that reduces the side effects of anti-cancer treatments. For example, the agent can be leucovorin.

Combination therapies that include administering an MMP-9/MMP-2 binding protein or other binding protein described herein can also be used to treat a subject having or at risk for another angiogenesis related disorder (e.g., a disorder other than cancer, e.g., disorders that include undesired endothelial cell proliferation or undesirable inflammation, e.g., rheumatoid arthritis).

Diagnostic Uses

Proteins that bind to MMP-9 and MMP-2 and identified by the method described herein and/or detailed herein have in vitro and in vivo diagnostic utilities. The MMP-9/MMP-2 binding proteins described herein (e.g., the proteins that bind and inhibit, or the proteins that bind but do not inhibit MMP-9 and MMP-2) can be used, e.g., for in vivo imaging, e.g., during a course of treatment for a disease or condition in which MMP-9 and/or MMP-2 is active, e.g., a disease or condition described herein, or in diagnosing a disease or condition described herein.

In one aspect, the disclosure provides a diagnostic method for detecting the presence of an MMP-9, an MMP-2 or both, in vitro or in vivo (e.g., in vivo imaging in a subject). The method can include localizing MMP-9, MMP-2 or both within a subject or within a sample from a subject. With respect to sample evaluation, the method can include, for example: (i) contacting a sample with MMP-9/MMP-2 binding protein; and (ii) detecting location of the MMP-9/MMP-2 binding protein in the sample.

An MMP-9/MMP-2 binding protein can also be used to determine the qualitative or quantitative level of expression of MMP-9 and/or MMP-2 in a sample. The method can also include contacting a reference sample (e.g., a control sample) with the binding protein, and determining a corresponding assessment of the reference sample. A change, e.g., a statistically significant change, in the formation of the complex in the sample or subject relative to the control sample or subject can be indicative of the presence of MMP-9 and/or MMP-2 in the sample.

The MMP-9/MMP-2 binding proteins are also useful for in vivo tumor imaging. Better clinical endpoints are needed to monitor the efficacy of drugs, such as MMP-inhibitors, that are designed to block enzymatic function (Zucker et al, 2001, Nature Medicine 7:655-656). Imaging of tumors in vivo by using labeled MMP-9/MMP-2 binding proteins could be of help to target the delivery of the binding protein to tumors for cancer diagnosis, intraoperative tumor detection, and for investigations of drug delivery and tumor physiology. MMP-9/MMP-2 binding proteins can be used to monitor native enzymatic activity in vivo at invasive sites. Another exemplary method includes: (i) administering the MMP-9/MMP-2 binding protein to a subject; and (iii) detecting location of the MMP-9/MMP-2 binding protein in the subject. The detecting can include determining location or time of formation of the complex.

The MMP-9/MMP-2 binding protein can be directly or indirectly labeled with a detectable substance to facilitate detection of the bound or unbound antibody. Suitable detectable substances include various enzymes, prosthetic groups, fluorescent materials, luminescent materials and radioactive materials.

Complex formation between the MMP-9/MMP-2 binding protein and MMP-9 and/or MMP-2 can be detected by evaluating the binding protein bound to the MMP-9 and/or MMP-2 or unbound binding protein. Conventional detection assays can be used, e.g., an enzyme-linked immunosorbent assays (ELISA), a radioimmunoassay (RIA) or tissue immunohistochemistry. Further to labeling the MMP-9/MMP-2 binding protein, the presence of MMP-9 and/or MMP-2 can be assayed in a sample by a competition immunoassay utilizing standards labeled with a detectable substance and an unlabeled MMP-9/MMP-2 binding protein. In one example of this assay, the biological sample, the labeled standards, and the MMP-9/MMP-2 binding protein are combined and the amount of labeled standard bound to the unlabeled binding protein is determined. The amount of MMP-9 and/or MMP-2 in the sample is inversely proportional to the amount of labeled standard bound to the MMP-9/MMP-2 binding protein.

Fluorophore and chromophore labeled proteins can be prepared. Because antibodies and other proteins absorb light having wavelengths up to about 310 nm, the fluorescent moieties should be selected to have substantial absorption at wavelengths above 310 nm and preferably above 400 nm. A variety of suitable fluorescers and chromophores are described by Stryer, 1968, Science 162:526 and Brand, L. et al., 1972, Annu. Rev. Biochem. 41:843 868. The proteins can be labeled with fluorescent chromophore groups by conventional procedures such as those disclosed in U.S. Pat. Nos. 3,940,475, 4,289,747, and 4,376,110. One group of fluorescers having a number of the desirable properties described above is the xanthene dyes, which include the fluoresceins and rhodamines. Another group of fluorescent compounds are the naphthylamines. Once labeled with a fluorophore or chromophore, the protein can be used to detect the presence or localization of the MMP-9 and/or MMP-2 in a sample, e.g., using fluorescent microscopy (such as confocal or deconvolution microscopy).

Histological Analysis. Immunohistochemistry can be performed using the proteins described herein. For example, in the case of an antibody, the antibody can be synthesized with a label (such as a purification or epitope tag), or can be detectably labeled, e.g., by conjugating a label or label-binding group. For example, a chelator can be attached to the antibody. The antibody is then contacted to a histological preparation, e.g., a fixed section of tissue that is on a microscope slide. After an incubation for binding, the preparation is washed to remove unbound antibody. The preparation is then analyzed, e.g., using microscopy, to identify if the antibody bound to the preparation.

Of course, the antibody (or other polypeptide or peptide) can be unlabeled at the time of binding. After binding and washing, the antibody is labeled in order to render it detectable.

Protein Arrays. The MMP-9 binding protein can also be immobilized on a protein array. The protein array can be used as a diagnostic tool, e.g., to screen medical samples (such as isolated cells, blood, sera, biopsies, and the like). Of course, the protein array can also include other binding proteins, e.g., that bind to MMP-9, MMP-2 or to other target molecules.

Methods of producing polypeptide arrays are described, e.g., in De Wildt et al., 2000, Nat. Biotechnol. 18:989-994; Lueking et al., 1999, Anal. Biochem. 270:103-111; Ge, 2000, Nucleic Acids Res. 28, e3, I-VII; MacBeath and Schreiber, 2000, Science 289:1760-1763; WO 01/40803 and WO 99/51773A1. Polypeptides for the array can be spotted at high speed, e.g., using commercially available robotic apparati, e.g., from Genetic MicroSystems or BioRobotics. The array substrate can be, for example, nitrocellulose, plastic, glass, e.g., surface-modified glass. The array can also include a porous matrix, e.g., acrylamide, agarose, or another polymer.

For example, the array can be an array of antibodies, e.g., as described in De Wildt, supra. Cells that produce the proteins can be grown on a filter in an arrayed format. Polypeptide production is induced, and the expressed polypeptides are immobilized to the filter at the location of the cell. A protein array can be contacted with a labeled target to determine the extent of binding of the target to each immobilized polypeptide. Information about the extent of binding at each address of the array can be stored as a profile, e.g., in a computer database. The protein array can be produced in replicates and used to compare binding profiles, e.g., of a target and a non-target.

FACS (Fluorescence Activated Cell Sorting). The MMP-9/MMP-2 binding protein can be used to label cells, e.g., cells in a sample (e.g., a patient sample). The binding protein is also attached (or attachable) to a fluorescent compound. The cells can then be sorted using fluorescence activated cell sorter (e.g., using a sorter available from Becton Dickinson Immunocytometry Systems, San Jose Calif.; see also U.S. Pat. Nos. 5,627,037; 5,030,002; and 5,137,809). As cells pass through the sorter, a laser beam excites the fluorescent compound while a detector counts cells that pass through and determines whether a fluorescent compound is attached to the cell by detecting fluorescence. The amount of label bound to each cell can be quantified and analyzed to characterize the sample.

The sorter can also deflect the cell and separate cells bound by the binding protein from those cells not bound by the binding protein. The separated cells can be cultured and/or characterized.

In Vivo Imaging. Also featured is a method for detecting the presence of a MMP-9 expressing and/or MMP-2 expressing tissue in vivo. The method includes (i) administering to a subject (e.g., a patient having, e.g., a cancer (e.g., metastatic cancer, e.g., metastatic breast cancer), an inflammatory disease (.g., chronic obstructive pulmonary disease (COPD), asthma, rhinitis (e.g., allergic rhinitis), inflammatory bowel disease, synovitis, rheumatoid arthritis), heart failure, septic shock, neuropathic pain, osteoarthritis, or an ocular condition (e.g., macular degeneration)) an anti-MMP-9/MMP-2 antibody, conjugated to a detectable marker; (ii) exposing the subject to a means for detecting said detectable marker to the MMP-9/MMP-2 expressing tissues or cells. For example, the subject is imaged, e.g., by NMR or other tomographic means.

Examples of labels useful for diagnostic imaging include radiolabels such as $^{131}$I, $^{111}$In, $^{123}$I, $^{99m}$Tc, $^{32}$P, $^{125}$I, $^{3}$H, $^{14}$C, and $^{188}$Rh, fluorescent labels such as fluorescein and rhodamine, nuclear magnetic resonance active labels, positron emitting isotopes detectable by a positron emission tomography ("PET") scanner, chemiluminescers such as luciferin, and enzymatic markers such as peroxidase or phosphatase. Short range radiation emitters, such as isotopes detectable by short range detector probes can also be employed. The protein can be labeled with such reagents; for example, see Wensel and Meares, 1983, *Radioimmunoimaging and Radioimmunotherapy*, Elsevier, N.Y. for techniques relating to the radiolabeling of antibodies and D. Colcher et al., 1986, *Meth. Enzymol.* 121: 802 816.

The binding protein can be labeled with a radioactive isotope (such as $^{14}$C, $^{3}$H, $^{35}$S, $^{125}$I, $^{32}$P, $^{131}$I). A radiolabeled binding protein can be used for diagnostic tests, e.g., an in vitro assay. The specific activity of a isotopically-labeled binding protein depends upon the half life, the isotopic purity of the radioactive label, and how the label is incorporated into the antibody.

In the case of a radiolabeled binding protein, the binding protein is administered to the patient, is localized to cells bearing the antigen with which the binding protein reacts, and is detected or "imaged" in vivo using known techniques such as radionuclear scanning using e.g., a gamma camera or emission tomography. See e.g., A. R. Bradwell et al., "Developments in Antibody Imaging", *Monoclonal Antibodies for Cancer Detection and Therapy*, R. W. Baldwin et al., (eds.), pp 65 85 (Academic Press 1985). Alternatively, a positron emission transaxial tomography scanner, such as designated Pet VI located at Brookhaven National Laboratory, can be used where the radiolabel emits positrons (e.g., $^{11}$C, $^{18}$F, $^{15}$O, and $^{13}$N).

MRI Contrast Agents. Magnetic Resonance Imaging (MRI) uses NMR to visualize internal features of living subject, and is useful for prognosis, diagnosis, treatment, and surgery. MRI can be used without radioactive tracer compounds for obvious benefit. Some MRI techniques are summarized in EP-A-0 502 814. Generally, the differences related to relaxation time constants T1 and T2 of water protons in different environments is used to generate an image. However, these differences can be insufficient to provide sharp high resolution images.

The differences in these relaxation time constants can be enhanced by contrast agents. Examples of such contrast agents include a number of magnetic agents paramagnetic agents (which primarily alter T1) and ferromagnetic or superparamagnetic (which primarily alter T2 response). Chelates (e.g., EDTA, DTPA and NTA chelates) can be used to attach (and reduce toxicity) of some paramagnetic substances (e.g., $Fe^{+3}$, $Mn^{+2}$, $Gd^{+3}$). Other agents can be in the form of particles, e.g., less than 10 mm to about 10 nM in diameter). Particles can have ferromagnetic, antiferromagnetic, or superparamagnetic properties. Particles can include, e.g., magnetite ($Fe_3O_4$), $\gamma$-$Fe_2O_3$, ferrites, and other magnetic mineral compounds of transition elements. Magnetic particles may include: one or more magnetic crystals with and without nonmagnetic material. The nonmagnetic material can include synthetic or natural polymers (such as sepharose, dextran, dextrin, starch and the like.

The MMP-9 binding protein can also be labeled with an indicating group containing of the NMR active $^{19}$F atom, or a plurality of such atoms inasmuch as (i) substantially all of naturally abundant fluorine atoms are the $^{19}$F isotope and, thus, substantially all fluorine containing compounds are NMR active; (ii) many chemically active polyfluorinated compounds such as trifluoracetic anhydride are commercially available at relatively low cost; and (iii) many fluorinated compounds have been found medically acceptable for use in humans such as the perfluorinated polyethers utilized to carry oxygen as hemoglobin replacements. After permitting such time for incubation, a whole body MRI is carried out using an apparatus such as one of those described by Pykett, 1982, *Sci. Am.* 246:78 88 to locate and image tissues expressing MMP-9 and MMP-2.

The contents of all references, pending patent applications and published patents, cited throughout this application are hereby expressly incorporated by reference. The following examples provide further illustrate and are not limiting.

EXAMPLES

Throughout this disclosure, in reference to binding proteins, the format of a capital letter followed by a zero and three digits-dash-letter and two digits (e.g., M0237-D02) refers to the same protein as the format of a capital letter followed by three digits-dash-letter and two digits (e.g., M237-D02). For example, the antibody M0237-D02 is also referred to as M237-D02. Further, a prefix may or may not be present; the presence of the prefix does not change which protein is being referred to. For example, the antibody 539A-M0237-D02 is also referred to as M0237-D02 or M237-D02.

Example 1

Selection and Screening of Anti-MMP-9 Fabs and IgGs

Two strategies were employed to identify anti-MMP-9 antibodies:

(1) Capture of a non-biotinylated form of MMP-9 (PMA-activated) by a biotinylated binding but not inhibiting Fab with the subsequent immobilization of the biotinylated entity on a streptavidin coated surface; and (2) MMP-9 (PMA activated) in solution. Phage, suitably depleted (e.g., previous contact with streptavidin) were allowed to interact with the target, unbound phage washed away and the output sampled and/or amplified for the next round of selection. This was repeated until the output phage in ELISA analysis indicate a high percentage of binders. 128/2076 unique sFabs were identified by ELISA and sequencing.

After sequencing analysis, the phage display were converted into sFabs and then into IgG1s. Their ability to inhibit MMP-9 and other MMPs (1, 3, 7, 8, 9, 10, 12, 13, 14) was determined by usual means. Compounds were initially screened at 1 µM against MMP-9 and those compounds that inhibited MMP-9>80% were subjected to additional screens against purified recombinant human MMP-2 (APMA activated enzyme) and other MMPs. For these additional screens, an $IC_{50}$ value was determined. Ki values and specificities of the inhibitors were determined as described below.

Example 2

Ki Determination for Human and Mouse MMP-9

This example characterized the interaction of the M0237-D02 hIgG1 with the human and mouse MMP-9. The Ki was measured and the inhibition mechanism was determined.

Materials:
Substrate: Mca -KPLGL-Dap(Dnp)-AR-NH$_2$(SEQ ID NO: 1279) (M-2350) from BACHEM (521575). A 10mM stock solution was prepared in DMSO.
Enzymes:
  Human MMP-9 catalytic domain (BIOMOL, SE-244). Enzyme concentration was measured by titration with TIMP-1 (2522-104)
  Mouse MMP-9 (R&D, 909-MM), APMA-activated.
M0237-D02 hIgG1 : 2517-014. Dialysed against TCN.
TCNB: 50 mM Tris/HCl, 10 mM CaCl$_2$, 150 mM NaCl, 0.05% Brij 35, pH 7.5.
96-well black plates from Perkin Elmer (6005270)
Spectramax M2e to measure fluorescence emission of the substrate upon hydrolysis (temperature control set at 30° C.; $\lambda_{exc}$=328 nm and $\lambda_{em}$=393 nm)
K$_i$ Measurements and Inhibition Model Characterization
The enzyme (final concentration=0.23 and 0.17 nM for the human and mouse MMP-9, respectively) was preincubated with various concentrations (0-50 nM) of M0237-D02 for 1 h at 30° C. The substrate was then added to a final concentration ranging from 5 to 40 µM and initial rates were recorded.

Each data point was measured in triplicate, and initial rates were averaged.

Averaged initial rates were plotted against the M0237-D02 concentration for each substrate concentration, and IC50's were calculated using the following equation:

$$y = \frac{Range}{1 + \left(\frac{x}{IC_{50}}\right)^s}$$

Figure 1B:
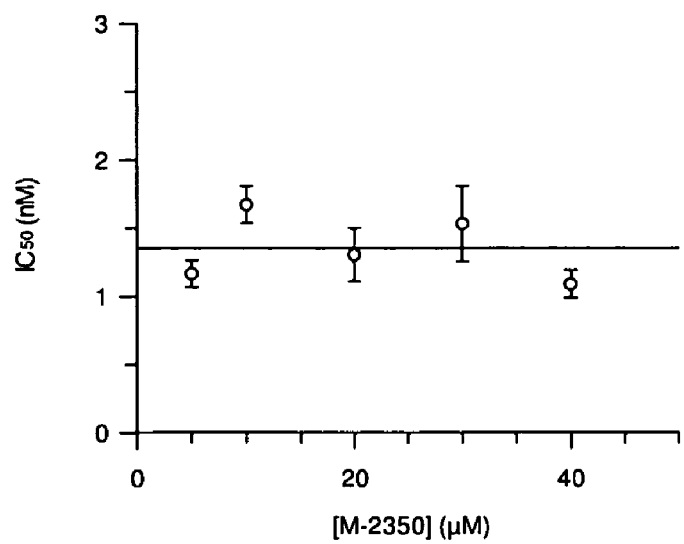

FIGS. 1A and 1B are two line graphs showing IC$_{50}$ (nM) versus substrate concentration (µM) of an MMP-9 binding protein (539A-M0237-D02). In FIG. 1A, the substrate is human MMP-9. In FIG. 1B, the substrate is mouse MMP-9.

The IC$_{50}$ values were then plotted against the substrate concentration.

Ki Determination and Inhibition Model Characterization

As shown in FIGS. 1A and 2B, a Ki of 0.92±0.04 nM for the human MMP-9 and 1.3±0.1 nM for the mouse MMP-9 were calculated.

Example 3

Interaction of M0166-F10 & M0237-D02 with a h-TIMP-1/h-MMP-9 Complex

Experimental data obtained with fluorogenic peptide substrates suggest that M0237-D02 behaves as a non competitive inhibitor of the human and mouse MMP-9. The non competitive inhibition model implies that the ternary complex enzyme-substrate-inhibitor can form. It is however possible that this complex cannot form with bigger substrates, in which case the antibody would behave as a competitive inhibitor. In order to address this issue, the ability of M0237-D02 antibody to bind to the h-MMP-9 when the enzyme is complexed to its natural inhibitor h-TIMP-1 was determined. The reasoning is that if the antibody cannot bind to the h-MMP-9/h-TIMP-1 complex, it would probably behave as a competitive inhibitor of this enzyme in the presence of bigger substrates. Alternatively, if the ternary complex enzyme-TIMP-1-antibody can form, it is likely that the antibody will behave as a non competitive inhibitor even in the presence of large substrates.

Experiments were performed at 25° C. with the help of a Biacore 3000 instrument. The MMP-9 binding protein (M0166F10) and the M0237-D02 antibody were coated to a CM5 chip either via standard amine coupling or using an anti-Fc antibody surface. Then either the active, human MMP-9 catalytic domain (BIOMOL, SE-244), the human pro-MMP-9 (R&D, 911-MP), the human TIMP-1 (R&D, 970-TM) or a h-MMP-9/h-TIMP-1 complex were flowed over the antibody surfaces, and binding was recorded. The data are summarized in the table below.

TABLE 3

|  | 539A-M0166F10 | | 539A-M0237D02 | |
| --- | --- | --- | --- | --- |
|  | Direct capture | Fc capture | Direct capture | Fc capture |
| Cat-huMMP-9 | Yes (slow binding) | Yes (slow binding) | No | Yes (slow binding) |
| Pro-huMMP-9 | ~No | ND | No | ND |
| huTIMP-1 | No | ND | No | ND |
| huTIMP-1/cat-huMMP-9 | No | ND | No | No |

ND—not determined

It was shown that the human MMP-9 catalytic domain binds to M0166-F10, whether this antibody is directly captured via amine coupling or captured with an anti-Fc antibody surface. By contrast, no binding was observed to M0166-F10 when the enzyme was complexed to the h-TIMP-1. Binding of the human MMP-9 catalytic domain to M0237-D02 could be observed only if this antibody was captured via an anti-Fc antibody, which suggests that amine coupling results in the inactivation of M0237-D02. Similarly to M0166-F10, no binding was observed with the MMP-9/TIMP-1 complex. Interestingly, binding to the pro-MMP-9 was observed neither for M237-D02 nor for M0166-F10.

This indicates that M0237-D02 cannot bind to the TIMP-1/MMP-9 complex, which suggests that it would behave as a competitive inhibitor in the presence of bigger substrates. Similar findings for the M0166-F10 antibody suggest that the latter is also a competitive inhibitor, at least with large substrates.

Example 4

Inhibition of Human MMP-9 by M0237-D02: Progress Curves and Kinetic Analysis

The kinetics of the interaction between M0237-D02 and the human MMP-9 were determined. The rates were determined using the following equation:

$$E + I \underset{k_{off}}{\overset{k_{on}}{\rightleftharpoons}} EI$$

and $$K_i = \frac{k_{off}}{k_{on}} = \frac{[E] \cdot [I]}{[EI]}$$

The second order rate constant for the association of the enzyme E and the inhibitor I ($k_{on}$) and the first order rate constant for the dissociation of the complex EI ($k_{off}$) can be calculated from inhibition progress curves obtained at different inhibitor concentrations.

Materials:
Substrate: Mca -KPLGL-Dap(Dnp)-AR-NH$_2$(SEQ ID NO: 1279) (M-2350) from BACHEM (521575). A 10mM stock solution was prepared in DMSO.
Human MMP-9 catalytic domain (BIOMOL, SE-244).
M0237-D02 hIgG1 : 2517-068.
All measurements were performed at 25° C. in TCNB: 50 mM Tris/HCl, 10 mM CaCl$_2$, 150mM NaCl 0.05% Brij 35, pH 7.5.
96-well black plates from Perkin Elmer (6005270)
Spectramax M2e to measure fluorescence emission of the substrate upon hydrolysis ($\lambda_{exc}$=328 nm and $\lambda_{em}$=393 nm)

Procedure:

The enzyme (at a final concentration ranging from 1.5 to 12.3 nM), the substrate (9 μM final) and the M0237-D02 antibody were mixed, and the fluorescence was immediately recorded in order to follow the hydrolysis of the substrate. The observed inhibition rate ($k_{obs}$) was obtained by analyzing the progress curves with a single exponential. The value for $k_{on}$ and $k_{off}$ were calculated from the plot of the $k_{obs}$ vs. the antibody concentration using the following equation:

$$k_{obs}=k_{on}[I]+k_{off}$$

$k_{obs}$ was measured at four antibody concentrations (table below):

TABLE 4

| M0237-D02 concentration (nM) | $k_{obs}$ (s$^{-1}$) |
|---|---|
| 14.4 | 0.0013 |
| 19.2 | 0.0019 |
| 28.8 | 0.0024 |
| 115.2 | 0.0086 |

The plot of $k_{obs}$ vs. the antibody concentration (below) gave $k_{on}$~7 10$^4$ M$^{-1}$ s$^{-1}$ and $k_{off}$~4 10$^{-4}$ s$^{-1}$.

Example 5

Film In situ Zymography

PBS-control treated tumors were screened with M0237-D02 for gelatinase expression using the FIZ approach. The tumors tested were Colo205 and MCF-7. Briefly, frozen slides of tumpor sections were dried at room temperature and 200 μl of in situ Zymo buffer (TCNB)+20 μg/ml of gelatin quenched substrate from molecular probes was added. The slides were incubate at 37° c. overnight in the presence of M0237-D02 at 500 nM or GM6001 used as a positive control at 100 μM. The substrate was washed in MilliQ (3 times) and the mounted slides were treated with anti-Fade+Dapi mounting medium.

In the Colo205 and MCF-7 tumor sections, a complete inhibition of gelatinolytic activity was observed in the presence of the dual MMP-2/-9 inhibitor M0237-D02 (500 nM) and M0237-D02 binds and inhibits tumoral MMP-2-9.

Example 6

Evaluation of 539A-M0237-D02 in Inflammation

The purpose of the following experiments were to determine the effect of 539A-M0237-D02 on inflammation and specifically on inflammatory cell infiltration into the carrageenan-stimulated mouse air pouch and on the arthritic index in collagen-induced arthritis (CIA) mice.

For the carrageenan-stimulated mouse air pouch model, subcutaneous injection of air into the hind flank or back of mice produces an air pouch in a week, the interior surface of which contains both fibroblast-like and macrophage-like cells. Inflammatory stimulation of the pouch results in leukocyte recruitment to the pouch and release of mediators (cytokines) into the exudate. Preventing inflammatory cell infiltration into the air pouch may translate into preventing inflammation of the synovium in rheumatoid arthritis.

Figure 2:
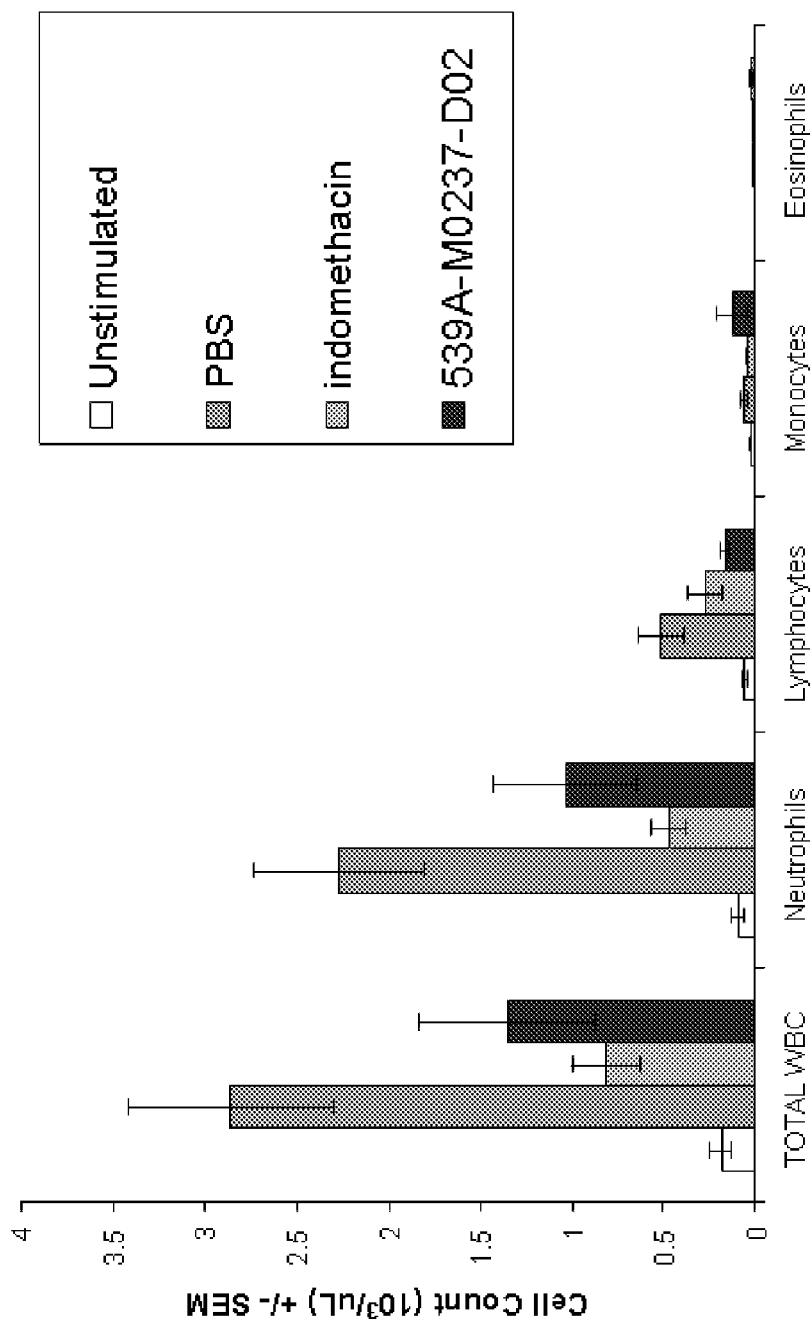
FIG. 2 is a bar graph showing the effect of an MMP-9/MMP-2 binding protein (539A-M0237-D02) on inflammatory cell infiltration into a carrageenan-stimulated mouse air pouch.

The effect of 539A-M0237-D02 on inflammatory cell infiltration was compared to inflammatory cell infiltration indomethacin and a control (PBS). In addition, inflammatory cell recruitment was compared to an unstimulated mouse. As shown in FIG. 2, 539A-M0237-D02 significantly decreased total white blood cell infiltration and specifically neutrophil and lymphocyte infiltration.

The collagen-induced arthritis (CIA) was produced by the immunization of susceptible strains of mice with native type II collagen. The collagen was emulsified in Freund's complete adjuvant and injected subcutaneously. A booster injection of collagen in incomplete adjuvant was given IP 21 days after the initial immunization. The disease is due to an autoimmune response induced upon immunization with collagen.

Figure 3:
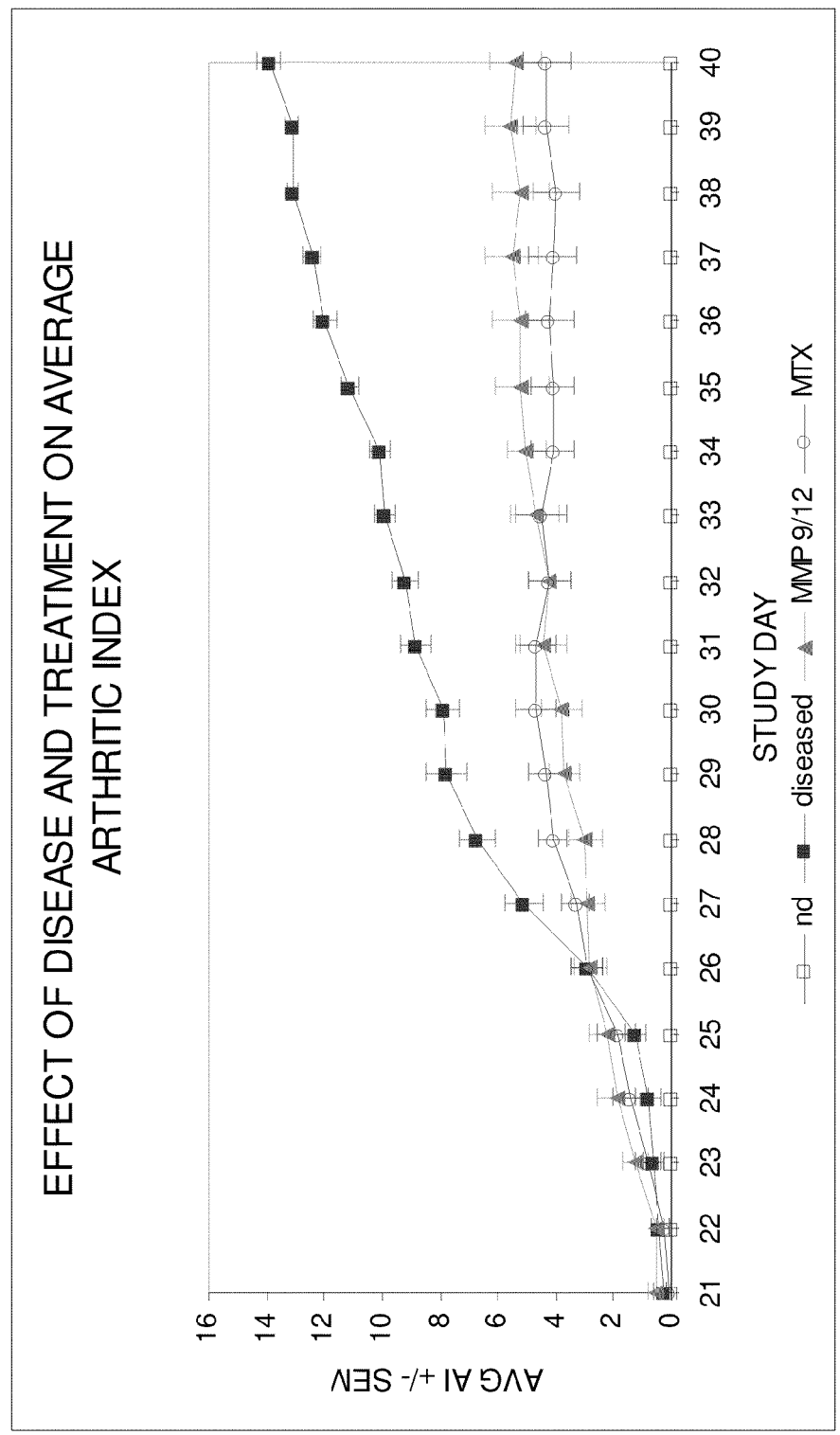
FIG. 3 is a graph showing the effect of an MMP-9/MMP-2 binding protein (539A-M0237-D02) on arthritic index.

The effect 539A-M0237-D02 on the arthritic index was compared to administration of methotrexate (MTX). As shown in FIG. 3, the arthritic index was decreased in the CIA model as compared to untreated mice.

Example 7

The DNA and amino acid sequences of variable regions of 539A-M0237-D02 sFAB are as follows:

```
539A-M0237-D02 (phage/SFAB) VL leader + VL
                                        SEQ ID NO: 2
TTCTATTCTCACAGTGCACAAGACATCCAGATGACCCAGTCTCCAGCCAC

CCTGTCTTTGTCTCCAGGGGAAAGAGCCACCCTCTCCTGCAGGGCCAGTC

AGAGTATTAGCAGCTTCTTAGCCTGGTACCAACAGAAACCTGGCCAGGCT

CCCAGGCTCCTCATCTATGATGCATCGTATAGGGCCACTGGCATCCCAGC

CAGGTTCAGTGGCAGTGGGTCTGGGACAGACTTCACTCTCACCATCAGCA

GCCTGGAGCCTGAAGATTATGCAGTTTATTACTGTCAGCAGCGTGGCAAC

TGGCCTATCACCTTCGGCCAAGGGACGCGGCTGGAGATTAAACGAACTGT

GGCTGCACCATCT

SEQ ID NO: 3
FYSHSAQDIQMTQSPATLSLSPGERATLSCRASQSISSFLAWYQQKPGQA

PRLLIYDASYRATGIPARFSGSGSGTDFTLTISSLEPEDYAVYYCQQRGN

WPITFGQGTRLEIKRTVAAPS

539A-M0237-D02 (phage/SFAB) VH leader + VH
                                        SEQ ID NO: 4
ATGAAGAAGCTCCTCTTTGCTATCCCGCTCGTCGTTCCTTTTGTGGCCCA

GCCGGCCATGGCCGAAGTTCAATTGTTAGAGTCTGGTGGCGGTCTTGTTC

AGCCTGGTGGTTCTTTACGTCTTTCTTGCGCTGCTTCCGGATTCACTTTC

TCTCAGTACCCTATGTGGTGGGTTCGCCAAGCTCCTGGTAAAGGTTTGGA

GTGGGTTTCTTATATCGTTCCTTCTGGTGGCCGTACTTATTATGCTGACT
```

-continued
CCGTTAAAGGTCGCTTCACTATCTCTAGAGACAACTCTAAGAATACTCTC

TACTTGCAGATGAACAGCTTAAGGGCTGAGGACACGGCCGTGTATTACTG

TGCGAAAGATCGGGCCTACGGTGATTACGTGGGCTGGAACGGTTTTGACT

ACTGGGGCCAGGGCACCCTGGTCACCGTCTCAAGCGCCTCCACCAAGGGC

CCATCGGTCTTCCCGCTAGCACCCTCCTCCAAGAGC

SEQ ID NO: 5:
MKKLLFAIPLVVPFVAQPAMAEVQLLESGGGLVQPGGSLRLSCAASGFTF

SQYPMWWVRQAPGKGLEWVSYIVPSGGRTYYADSVKGRFTISRDNSKNTL

YLQMNSLRAEDTAVYYCAKDRAYGDYVGWNGFDYWGQGTLVTVSSASTKG

PSVFPLAPSSKS

Example 8

Studies with Colon Cancer Cells

Figure 4:
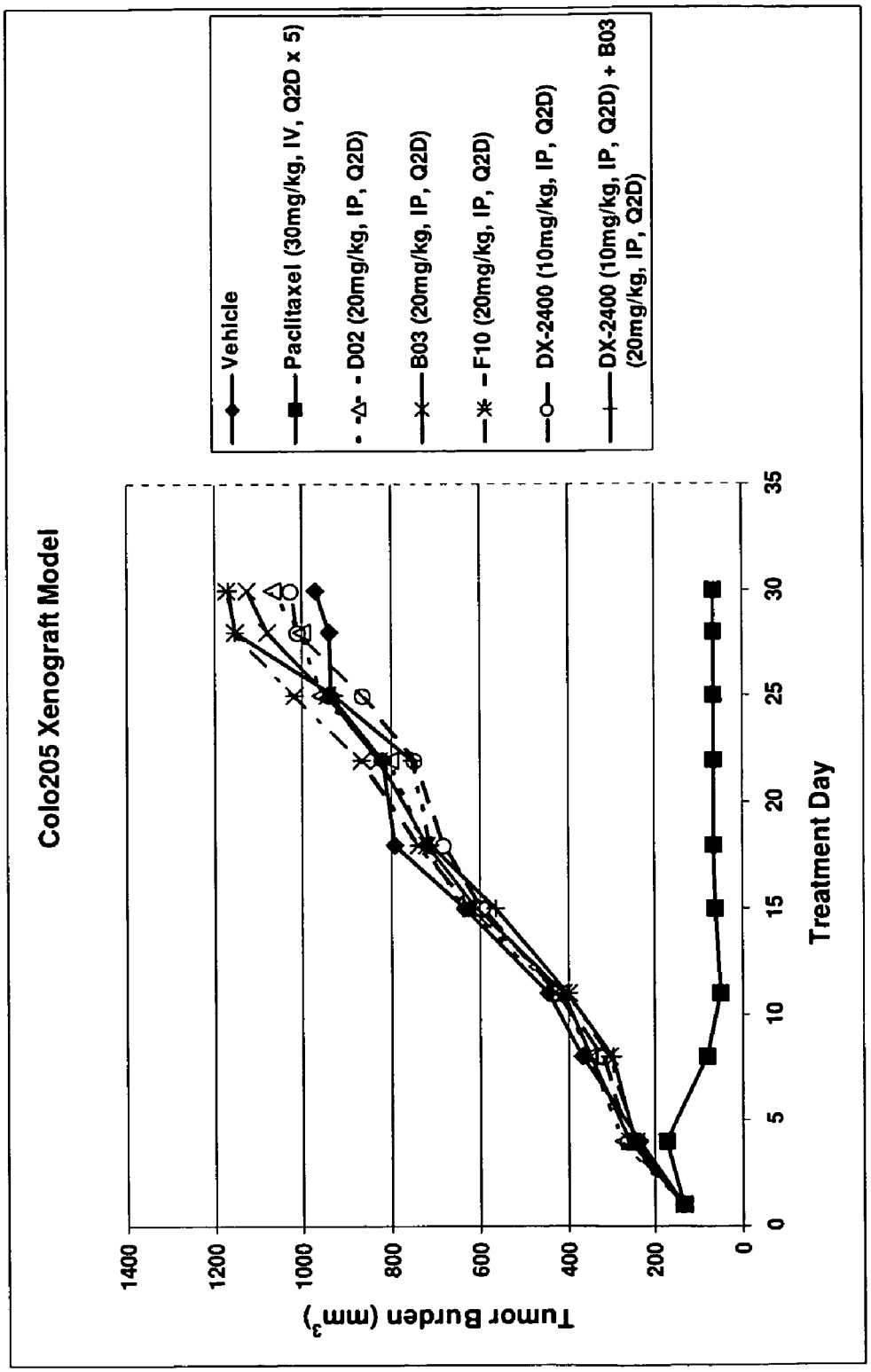
FIG. 4 is a line graph showing activity of MMP-9 binding proteins in a Colo205 colon xenograft cancer model.

The efficacies of novel antibodies DL8, DL12, DL15 and DL2 in the Colo205 colon carcinoma model were evaluated. The antibodies were tested alone or in combination. The results are shown in FIG. 4.

Drugs and Treatment:

|  |  |  |  | 1 Drug/Testing Agent | | | 2 Drug/Testing Agent | | | | |
| --- | --- | --- | --- | --- | --- | --- | --- | --- | --- | --- | --- |
| Gr. | N | Agent | Vehicle | mg/kg | Route | Schedule | Agent | Vehicle | mg/kg | Route | Schedule |
| 1# | 10 | vehicle | PBS | — | ip | qod to end | — | — | — | — | — |
| 2 | 10 | paclitaxel | 5% EC | 30 | iv | qod × 5 | — | — | — | — | — |
| 3 | 10 | DL8 | PBS | 20 | ip | qod to end | — | — | — | — | — |
| 4 | 10 | DL12 | PBS | 20 | ip | qod to end | — | — | — | — | — |
| 5 | 10 | DL15 | PBS | 20 | ip | qod to end | — | — | — | — | — |
| 6 | 10 | DL2 | Citrate buffer | 10 | ip | qod to end | — | — | — | — | — |
| 7 | 10 | DL2 | Citrate buffer | 10 | ip | qod to end | DL12 | PBS | 20 | ip | qod to end |

Control Group

Procedures:
Set up HRLN female nu/nu mice with 1×10⁶ Colo205 tumor cells in 50% Matrigel subcutaneously (sc) in flank
Do a pair match when tumors reach an average size of 100-150 mg, and begin treatment
Body Weight: daily for the first five days and then biwk to end
Caliper Measurement: biwk to end
Final body weights and calipers should be taken on the last day of the study.
Endpoint TGI (tumor growth inhibition). Animals are to be monitored as a group. The endpoint of the experiment is a mean tumor weight in Control Group of 1 gms or 45 days, whichever comes first. When the endpoint is reached, all the animals are to be euthanized.
Study Conditions:
Statistical analysis of the data will be performed using:
 Kruskal-Wallis with post hoc Dunn's test Groups 3-7 vs Group 1 and Group 7 vs Groups 4 and 6
 Mann-Whitney test Group1 vs Group 2
Clinical agent PACLITAXEL is for use as a positive control only
Dosing:
Prepare dosing solutions:
 DL2, DL8, DL12, DL15-every week, store at 4° C.
 paclitaxel—every dose, store at room temp DL12=B03 in PBS=539A-M0240-B03 IgG1 (h/mMMP-9 antibody inhibitor) (parental)
DL8=D02 in PBS 539A-M0237-D02 IgG1 (MMP-9/-2 dual reactive antibody inhibitor) (parental)
DL15=F10 in PBS 539A-M0166-F10 IgG1 (hMMP-9 antibody inhibitor) (parental)
DL2=DX-2400 in citrate buffer solution.
paclitaxel=paclitaxel in 5% Ethanol:5% Cremophor EL:90% D5W
vehicle=PBS
Dosing volume=10 mL/kg (0.200 mL/20 g mouse). Adjust volume accordingly for body weight.
Save remaining compound for future use
Discard remaining dosing solution
Sampling:
Sampling 1
 Timepoint: 24 hours post 5$^{th}$ dose of DL10 (Day 10)
 All Groups, the 6 Animals closest to mean:
 Blood Collection
  Collect full volume blood by terminal cardiac puncture under $CO_2$ anesthesia
  Process blood for:
   Serum (anti-coagulant—none, preservation—freeze, shipping condition—−80° C.)
Sampling 2
 Timepoint: 24 hours post 10$^{th}$ dose of DL10 (Day 20)
 All Groups, same animals sampled in Sampling 1:
 Blood Collection as above
Sampling 3
 Timepoint: at endpoint (24 hrs post last DL dose)
 All Groups All Animals:
 Blood Collection
  Collect full volume blood by terminal cardiac puncture under $CO_2$ anesthesia
  Process blood for:
   Serum (anti-coagulant—none, preservation—freeze, shipping condition—−80° C.)
 Organ Collection
  Tumor (weigh sample, divide into 2 parts)
   Part 1: preservation—snapfreeze in a cryovial, shipping condition—−80° C.
   Part 2: preservation—OCT, shipping condition—−80° C.

539A-M0240-B03: 539A-M0240-B03 is an inhibitory MMP-9 binding antibody. The variable domain sequences for 539A-M0240-B03 are:

Light Chain
Light V gene - VL2_2e 2e.2.2/V1-3/DPL12
Light J gene - JL3

```
                 FR1-L                      CDR1-L            FR2-L           CDR2-L
539A-M0240-B03: QYELTQPRSVSGSPGQSVTISC TGTSSDVGGYNYVS WYQQHPGKAPKLMIY DVSKRPS GVPD

FR3-L                      CDR3-L            FR4-L
539A-M0240-B03: RFSGSKSGNTASLTISGLQAEDEADYYC CSYAGSYTLV FGGGTKLTVL (SEQ ID NO: 1280)
```

Heavy Chain
Heavy V gene: VH3_3-23 DP-47/V3-23
Heavy J gene: JH3

```
                 FR1-H                          CDR1-H    FR2-H           CDR2-H
539A-M0240-B03: EVQLLESGGGLVQPGGSLRLSCAASGFTFS TYQMV WVRQAPGKGLEWVS VIYPSGGPTVYADSVKG

FR3-H                               CDR3-H         FR4-H
539A-M0240-B03: RFTISRDNSKNTLYLQMNSLRAEDTAVYYCAR GKDYYDSSGPGAFDI WGQGTMVTVSS (SEQ ID NO: 1281)
```

539A-M0166-F10: 539A-M0166-F10 is an inhibitory MMP-9 binding antibody. The variable domian sequences for 539A-M0166-F10 are:

539A-M0166-F10 (phage/SFAB) VL leader + VL
SEQ ID NO: 2:
TTCTATTCTCACAGTGCACAGAGCGAATTGACTCAGCCA

CCGTCAGCGTCTGCGGCCCCCGGGCAGAGGGTCACCAT

CTCTTGTTCTGGAAGCAGCTCCAACATCGGAAGTAACAC

TGTAACCTGGTACCAGAAGCTCCCAGGAACGGCCCCCA

AGCTCCTCATTTACAATAATTATGAGCGGCCCTCAGGGGT

CCCTGCCCGATTCTCTGGCTCCAAGTCTGGCACCTCA

GCCTCCCTGGCCATCAGTGGGCTCCAGTCTGAGGATGAGGC

TGATTATTACTGTGCAACATGGGATGACAGCCTGAT

TGCCAATTACGTCTTCGGAAGTGGGACCAAGGTCACC

GTCCTAGGTCAGCCCAAGGCCAACCCC

SEQ ID NO: 3:
FYSESAQSELTQPPSASAAPGQRVTISCSGSSSNIGSNT

VTWYQKLPGTAPKLLIYNNYERPSGVPARFSGSKSGTS

ASLAISGLQSEDEADYYCATWDDSLIANYVFGSGTKVTVLGQPKANP

539A-M0166-F10 (phage/SFAB) VH leader + VH
SEQ ID NO: 4:
ATGAAGAAGCTCCTCTTTGCTATCCCGCTCGTCGTTCCTT

TTGTGGCCCAGCCGGCCATGGCCGAAGTTCAATTGTT

AGAGTCTGGTGGCGGTCTTGTTCAGCCTGGTGGTTCTTT

ACGTCTTTCTTGCGCTGCTTCCGGATTCACTTTCTCTC

CTTACCTTATGAATTGGGTTCGCCAAGCTCCTGGTAAAG

GTTTGGAGTGGGTTTCTTCTATCTATTCTTCTGGTGGC

GGTACTGGTTATGCTGACTCCGTTAAAGGTCGCTTCACT

ATCTCTAGAGACAACTCTAAGAATACTCTCTACTTGCA

GATGAACAGCTTAAGGGCTGAGGACACGGCCGTGTATTA

CTGTGCGAGAATATACCATAGCAGCAGTGGACCTTTCT

ACGGTATGGACGTCTGGGGCCAAGGGACCACGGTCACCG

TCTCAAGCGCCTCCACCAAGGGCCCATCGGTCTTCCCG

CTAGCACCCTCCTCCAAGAGC

SEQ ID NO: 5:
MKKLLFAIPLVVPFVAQPAMAEVQLLESGGGLVQPGGSL

RLSCAASGFTFSPYLMNWVRQAPGKGLEWVSSIYSSGG

GTGYADSVKGRFTISRDNSKNTLYLQMNSLRAEDTAVYY

CARIYHSSSGPFYGMDVWGQGTTVTVSSASTKGPSVFP

LAPSSKS

DX-2400: DX-2400 is an inhibitory MMP-14 binding antibody. The variable domain sequences for DX-2400 are:

```
       VH:
              FR1--------------------------- CDR1- FR2----------- CDR2-------
       DX-2400 EVQLLESGGGLVQPGGSLRLSCAASGFTFS LYSMN WVRQAPGKGLEWVS SIYSSGGSTLY

CDR2-- FR3----------------------------- CDR3-- FR4---------
       DX-2400 ADSVKG RFTISRDNSKNTLYLQMNSLRAEDTAVYYCAR GRAFDI WGQGTMVTVSS
```

CDR regions are in bold.

```
       VL:
              FR1------------------- CDR1------- FR2------------ CDR2---
       DX-2400 DIQMTQSPSSLSASVGDRVTITC RASQSVGTYLN WYQQKPGKAPKLLIY ATSNLRS GVPS

FR3------------------------ CDR3------ FR4-------
       DX2400 RFSGSGSGTDFTLTISSLQPEDFATYYC QQSYSIPRFT FGPGTKVDIK
```

CDR regions are in bold.

539A-M0237-D02: The variable domain sequences for 539A-M0237-D02 are provided above.

Example 9

Studies with Pancreatic Cancer Cells

Figure 5:
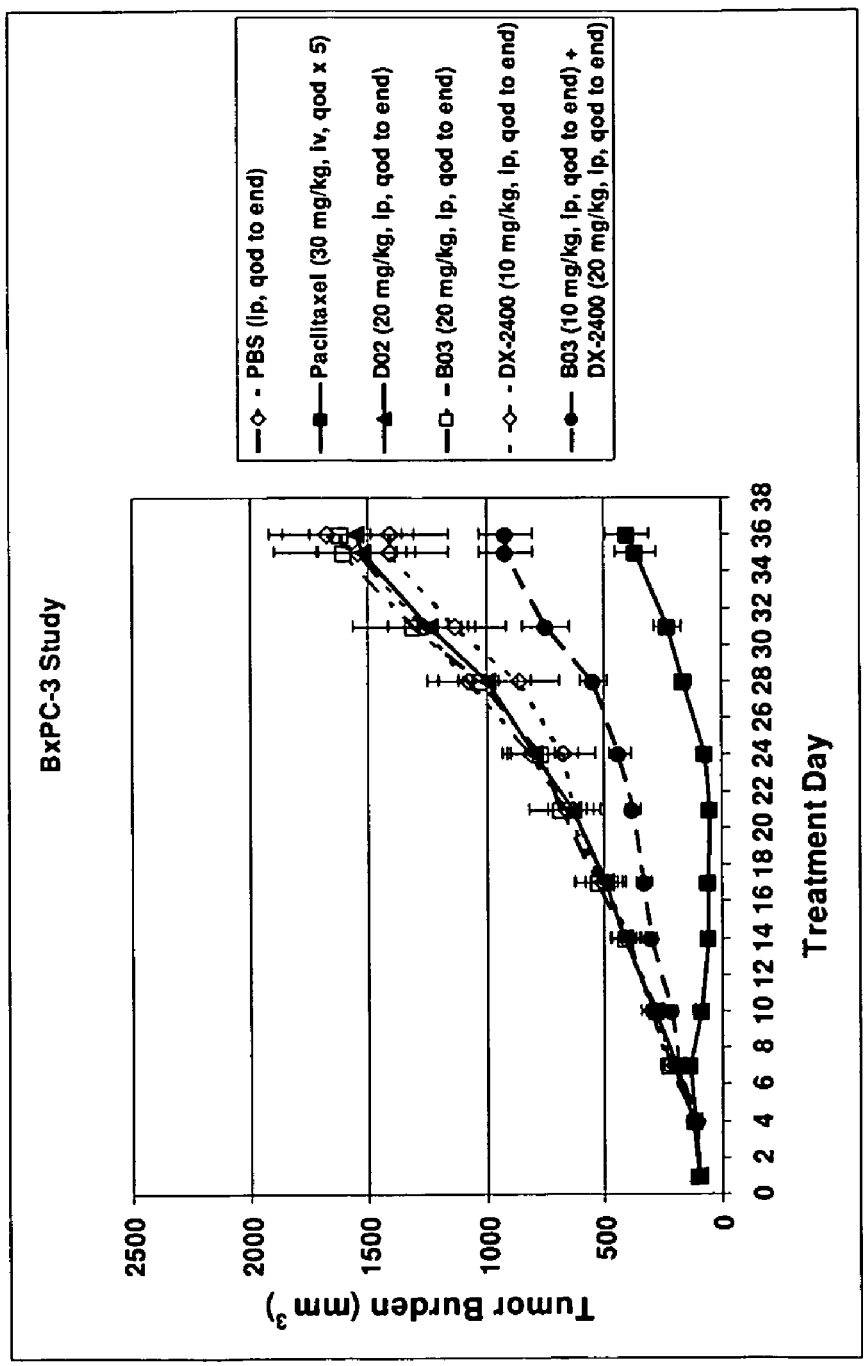
FIG. 5 is a line graph showing the efficacy of MMP-9 binding proteins in a BxPC-3 pancreatic cancer model.

The efficacies of novel antibodies DL8, DL12, and DL2 in the BxPC-3 pancreatic carcinoma model were evaluated. The antibodies were tested alone or in combination. The results are shown in FIG. 5.

Drugs and Treatment:

| | | 1 Drug/Testing Agent | | | | | 2 Drug/Testing Agent | | | |
|---|---|---|---|---|---|---|---|---|---|---|
| Gr. | N | Agent | Vehicle | mg/kg | Route | Schedule | Agent | Vehicle | mg/kg | Route | Schedule |
| 1# | 10 | vehicle | PBS | — | ip | qod to end | — | — | — | — | — |
| 2 | 10 | paclitaxel | 5% EC | 30 | iv | qod × 5 | — | — | — | — | — |
| 3 | 10 | DL8 | PBS | 20 | ip | qod to end | — | — | — | — | — |
| 4 | 10 | DL12 | PBS | 20 | ip | qod to end | — | — | — | — | — |
| 5 | 10 | DL2 | Citrate buffer | 10 | ip | qod to end | — | — | — | — | — |
| 6 | 10 | DL2 | Citrate buffer | 10 | ip | qod to end | DL12 | PBS | 20 | ip | qod to end |

Control Group

Procedures:
Set up HRLN female nu/nu mice with 1 mm³ Bx-PC3 tumor fragments sc in flank
Do a pair match when tumors reach an average size of 80-120 mg, and begin treatment
Body Weight: 5/2 then biwk to end
Caliper Measurement: biwk to end
Final body weights and calipers should be taken on the last day of the study.
Endpoint TGI. Animals are to be monitored as a group. The endpoint of the experiment is a mean tumor weight in Control Group of 1 gms or 45 days, whichever comes first. When the endpoint is reached, all the animals are to be euthanized.
Study Conditions:
Statistical analysis of the data will be performed using:
  Kruskal-Wallis with post hoc Dunn's test Groups 3-6 vs Group 1 and Group 6 vs Group 3 and Group 5
  Mann-Whitney test Group1 vs Group 2
Clinical agent PACLITAXEL is for use as a positive control only
Dosing:
Prepare dosing solutions:
  DL2, DL8, DL12—every week, store at 4° C.
  paclitaxel—every dose, store at room temp
DL12=B03 in PBS
DL8=D02 in PBS
DL2=DX-2400 in citrate buffer solution
paclitaxel=paclitaxel in 5% Ethanol:5% Cremophor EL:90% D5W
vehicle=PBS
Dosing volume=10 mL/kg (0.200 mL/20 g mouse). Adjust volume accordingly for body weight.
Save remaining compound for future use
Discard remaining dosing solution Sampling:
Sampling 1
  Timepoint: 24 hours post 5$^{th}$ dose (Day 10)
  All Groups 6 Animals closest to mean:
  Blood Collection
    Collect full volume blood by terminal cardiac puncture under $CO_2$ anesthesia
    Process blood for:
      Serum (anti-coagulant—none, preservation—freeze, shipping condition—-80° C.)
Sampling 2
  Timepoint: 24 hours post 10$^{th}$ dose (Day 20)
  All Groups same animals sampled in Sampling 1:
  Blood Collection as above
Sampling 3
  Timepoint: at endpoint (24 hours post last dose)
  All Groups All Animals:
  Blood Collection
    Collect full volume blood by terminal cardiac puncture under $CO_2$ anesthesia
    Process blood for:
      Serum (anti-coagulant—none, preservation—freeze, shipping condition—-80° C.)
  Organ Collection
    Tumor (weigh sample, divide into 2 parts)
      Part 1: preservation—snap freeze in a cryovial, shipping condition—-80° C.
      Part 2: preservation—OCT, shipping condition—-80° C.

Example 10

Affinity Matured Variants of 539A-M0237-D02

M237-D02 (also referred to herein as 539A-M0237-D02) was used as the parent antibody for affinity maturation. Two libraries were built and Fabs that bind all of the targets (hMMP9, hMMP2, mMMP9, and mMMP2) were selected. One library allows the selected LC of M237-D02 to be replaced with any LC of the FAB-310 library (Hoet et al., Nat. Biotechnol. 2005 23:344-348). The other library allowed HC CDR1-2 to be replaced by any HC CDR1-2 of the FAB-310 library. Table 5 gives the LV and HV CDR sequences of the affinity matured variants of M237-D02. Following Table 5 is a listing of the full sequence of LV and HV for these antibodies. Table 6 shows the selected FABs from the HC-CDR1-2 library at positions 25-66. Non-standard position 58a was allowed so that sequences having an insert could be displayed. In Table 6, "-" means that the sequence is identical to M237-D02; "#" means there is a deletion.

Table 5:CDRs of 627 hMMP2/hMMP9/mMMP9-inhibiting Abs (SEQ ID NOS 1286-5053, respectively, in order of appearance)

TABLE 5

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
| --- | --- | --- | --- | --- | --- | --- |
| M237-D02 | RASQSISSFLA | DASYRAT | QQRGNWPIT | QYPMW | YIVPSGGRTYYADSVKG | DRAYGDYVGWNGFDY |
| M265-C07 | RASQNVARFLA | SASNRAT | QQRGNWPIT | QYPMW | YIVPSGGRTYYADSVKG | DRAYGDYVGWNGFDY |
| M265-A07 | RASQNVHTYLA | EASNRAT | QQRGGWPIT | QYPMW | YIVPSGGRTYYADSVKG | DRAYGDYVGWNGFDY |
| M256-D03 | RASQISSFLA | DASYRAT | QQRGNWPIT | VYPMI | YISPSGGFTGYADSVKG | DRAYGDYVGWNGFDY |
| M256-E10 | RASQSISSFLA | DASYRAT | QQRGNWPIT | DYPMW | VIYPSGGATFYADSVKG | DRAYGDYVGWNGFDY |
| M256-E03 | RASQSISSFLA | DASYRAT | QQRGNWPIT | TYPMI | YISPSGGYTGYADSVKG | DRAYGDYVGWNGFDY |
| M256-D11 | RASQSISSFLA | DASYRAT | QQRGNWPIT | HYDMW | VIYSSGGPTFYADSVKG | DRAYGDYVGWNGFDY |
| M256-A04 | RASQSISSFLA | DASYRAT | QQRGNWPIT | HYPMW | SISPSGGATYYADSVKG | DRAYGDYVGWNGFDY |
| M256-G09 | RASQSISSFLA | DASYRAT | QQRGNWPIT | KYPMW | YISSSGGYTGYADSVKG | DRAYGDYVGWNGFDY |
| M256-A07 | RASQSISSFLA | DASYRAT | QQRGNWPIT | HYDML | YISSSGGYTGYADSVKG | DRAYGDYVGWNGFDY |
| M256-C09 | RASQSISSFLA | DASYRAT | QQRGNWPIT | KYPMW | YISSSGGGTFYADSVKG | DRAYGDYVGWNGFDY |
| M256-C07 | RASQSISSFLA | DASYRAT | QQRGNWPIT | LYDMW | YISSSGGATYYADSVKG | DRAYGDYVGWNGFDY |
| M256-B03 | RASQSISSFLA | DASYRAT | QQRGNWPIT | RYPMW | YISPSGGFTSYADSVKG | DRAYGDYVGWNGFDY |
| M266-E02 | RASQSVGRFLA | GASSRAT | QQRGNWPIT | QYPMW | YIVPSGGRTYYADSVKG | DRAYGDYVGWNGFDY |
| M266-D03 | RASQNIGSDLA | GASSRAT | QQRGNWPIT | QYPMW | YIVPSGGRTYYADSVKG | DRAYGDYVGWNGFDY |
| M263-F05 | RASQSVGNFLA | GASNRAT | QQRGNWPIT | QYPMW | YIVPSGGRTYYADSVKG | DRAYGDYVGWNGFDY |
| M264-A09 | RASQVIFSGLA | AASNLQS | QQAQTFPFT | QYPMW | YIVPSGGRTYYADSVKG | DRAYGDYVGWNGFDY |
| M263-F01 | RASQNIGRWLA | GASSLQT | QQRRKWPVT | QYPMW | YIVPSGGRTYYADSVKG | DRAYGDYVGWNGFDY |
| M265-A04 | RASQNIGSDLA | RASFRAT | QQRGNWPPT | QYPMW | YIVPSGGRTYYADSVKG | DRAYGDYVGWNGFDY |
| M278-C09 | RASQSISSFLA | DASYRAT | QQRGNWPIT | QYPMW | YIVPSGGRTYYADSVKG | DRAYGDYVGWNGFDY |
| M281-F06 | RASQSVSSDLA | GASTRAT | QQRSNWPVT | QYPMW | YIVPSGGRTYYADSVKG | DRAYGDYVGWNGFDY |
| M279-H01 | RATQGIGTFLA | GASTLQS | QQRYTWPIT | QYPMW | YIVPSGGRTYYADSVKG | DRAYGDYVGWNGFDY |
| M280-G04 | TASQSVGSHLA | DISSRAT | QQRYSWPLT | QYPMW | YIVPSGGRTYYADSVKG | DRAYGDYVGWNGFDY |
| M281-C08 | RASQSVSSDLA | GASTRAT | QQRAYWPVS | QYPMW | YIVPSGGRTYYADSVKG | DRAYGDYVGWNGFDY |
| M287-C10 | RASQHIYTSLA | EASYRAT | QQRGSWPIT | QYPMW | YIVPSGGRTYYADSVKG | DRAYGDYVGWNGFDY |
| M281-H08 | RASQSVSSYLA | GASTRAT | QQRGFWPIT | QYPMW | YIVPSGGRTYYADSVKG | DRAYGDYVGWNGFDY |
| M292-E02 | RASQSVSSYLA | GASNRAT | QQRGNWPIT | QYPMW | YIVPSGGRTYYADSVKG | DRAYGDYVGWNGFDY |
| M290-B12 | RASQSVSSVA | DTSNRAT | QQRTKWPIT | QYPMW | YIVPSGGRTYYADSVKG | DRAYGDYVGWNGFDY |
| M279-B07 | RASESVGMYIA | GASNRAT | QQRGNWPIT | QYPMW | YIVPSGGRTYYADSVKG | DRAYGDYVGWNGFDY |
| M296-E03 | GASQSVSSSYLA | DASSRAT | QQYGSSPWT | QYPMW | YIVPSGGRTYYADSVKG | DRAYGDYVGWNGFDY |
| M282-B10 | RASPSISNFLA | GASNRAT | QQRRSWPPT | QYPMW | YIVPSGGRTYYADSVKG | DRAYGDYVGWNGFDY |
| M283-D07 | RASQNIGGLYLA | GASNRAT | QQRSNWPPT | QYPMW | YIVPSGGRTYYADSVKG | DRAYGDYVGWNGFDY |
| M289-B05 | RASQNVANYLD | DGSNRAT | QQRHSWPPIT | QYPMW | YIVPSGGRTYYADSVKG | DRAYGDYVGWNGFDY |
| M283-D09 | RASQNVHTYLA | EASNRAT | QQRGGWPIT | QYPMW | YIVPSGGRTYYADSVKG | DRAYGDYVGWNGFDY |
| M284-B05 | RASQSIGNHLA | DASNRAT | QQRGNWPIT | QYPMW | YIVPSGGRTYYADSVKG | DRAYGDYVGWNGFDY |
| M293-E07 | RASQSISSFLA | DASYRAT | QQRGNWPIT | QYPMW | YIVPSGGRTYYADSVKG | DRAYGDYVGWNGFDY |
| M295-G02 | RASQSISSFLA | GASSRAR | QQRGNWPIT | QYPMW | YIVPSGGRTYYADSVKG | DRAYGDYVGWNGFDY |
| M293-D07 | RASQSISSFLA | GASTRAT | QQRGNWPIT | QYPMW | YIVPSGGRTYYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M278-B08 | RASQSISSHLA | GASSRAT | QQRGNWPIT | QYPMW | YIVPSGGRTYYADSVKG | DRAYGDYVGWNGFDY |
| M283-D02 | RASQSISISLA | DASNRA | QQRGAWPLT | QYPMW | YIVPSGGRTYYADSVKG | DRAYGDYVGWNGFDY |
| M281-A02 | RASQSLGRSDLA | GVSNRVT | QQRSNWPPT | QYPMW | YIVPSGGRTYYADSVKG | DRAYGDYVGWNGFDY |
| M280-H04 | RASQSLGRSDLA | GVSNRVT | QQRSTWPIT | QYPMW | YIVPSGGRTYYADSVKG | DRAYGDYVGWNGFDY |
| M285-D05 | RASQSLGSFLA | GASYRAT | QQRGNWPIT | QYPMW | YIVPSGGRTYYADSVKG | DRAYGDYVGWNGFDY |
| M285-C03 | RASQSVDSYLA | DASNRAT | QHRRSWPLT | QYPMW | YIVPSGGRTYYADSVKG | DRAYGDYVGWNGFDY |
| M284-A01 | RASQSVDSYLA | GASNRAT | QQRRKWPVT | QYPMW | YIVPSGGRTYYADSVKG | DRAYGDYVGWNGFDY |
| M279-F11 | RASQSVGGDIA | GASNRAT | QQRSYWPVT | QYPMW | YIVPSGGRTYYADSVKG | DRAYGDYVGWNGFDY |
| M279-B09 | RASQSVGRDLA | GATTRAT | QQRGNWPIT | QYPMW | YIVPSGGRTYYADSVKG | DRAYGDYVGWNGFDY |
| M281-F02 | RASQSVGSDLA | GASTART | QQRGNWPIT | QYPMW | YIVPSGGRTYYADSVKG | DRAYGDYVGWNGFDY |
| M297-F05 | RASQSVGSFLA | GASNRAT | QQRGNWPIT | QYPMW | YIVPSGGRTYYADSVKG | DRAYGDYVGWNGFDY |
| M285-C08 | RASQSVGSQLA | DASYRAT | QQRGNWPIT | QYPMW | YIVPSGGRTYYADSVKG | DRAYGDYVGWNGFDY |
| M292-H03 | RASQSVGTHLA | GASTRAT | QQRRSWPIT | QYPMW | YIVPSGGRTYYADSVKG | DRAYGDYVGWNGFDY |
| M288-E08 | RASQSVNHFLA | GASNRAT | QQRGSWPIT | QYPMW | YIVPSGGRTYYADSVKG | DRAYGDYVGWNGFDY |
| M283-H10 | RASQSVNSFLA | DASNRAT | QQRSWPIT | QYPMW | YIVPSGGRTYYADSVKG | DRAYGDYVGWNGFDY |
| M280-G06 | RASQSVNSYLA | DASNRAT | QQRGYWPPS | QYPMW | YIVPSGGRTYYADSVKG | DRAYGDYVGWNGFDY |
| M293-E02 | RASQSVSNFLA | GASSRAT | QQRGNWPIT | QYPMW | YIVPSGGRTYYADSVKG | DRAYGDYVGWNGFDY |
| M296-D03 | RASQSVSNYLA | GASTRAT | QQRGNWPIT | QYPMW | YIVPSGGRTYYADSVKG | DRAYGDYVGWNGFDY |
| M296-E02 | RASQSVSRYLA | DASSRAT | HQRSSWPIT | QYPMW | YIVPSGGRTYYADSVKG | DRAYGDYVGWNGFDY |
| M281-H07 | RASQSVSRYLA | DASNRAT | QQRINWPLT | QYPMW | YIVPSGGRTYYADSVKG | DRAYGDYVGWNGFDY |
| M283-C02 | RASQSVSSFLA | HASNRAT | QQRGNWPIT | QYPMW | YIVPSGGRTYYADSVKG | DRAYGDYVGWNGFDY |
| M282-E10 | RASQSVSSFLA | DASNRAS | QQRANWPLT | QYPMW | YIVPSGGRTYYADSVKG | DRAYGDYVGWNGFDY |
| M293-E12 | RASQSVSSHLA | GASSRAT | QQRGNWPIT | QYPMW | YIVPSGGRTYYADSVKG | DRAYGDYVGWNGFDY |
| M278-G02 | RASQSVSSYLA | DASNRAT | QQRGNWPIT | QYPMW | YIVPSGGRTYYADSVKG | DRAYGDYVGWNGFDY |
| M284-D11 | RASQSVSSYLA | GASNRAT | QQRGNWPIT | QYPMW | YIVPSGGRTYYADSVKG | DRAYGDYVGWNGFDY |
| M278-B03 | RASQSVSSYLA | GASHRAT | QQRSNWPIT | QYPMW | YIVPSGGRTYYADSVKG | DRAYGDYVGWNGFDY |
| M280-C06 | RASQSVSSYLA | DASNRAT | QQRGNWPIT | QYPMW | YIVPSGGRTYYADSVKG | DRAYGDYVGWNGFDY |
| M283-G06 | RASQSVSSYLA | DASNRAT | QQRSNWPIT | QYPMW | YIVPSGGRTYYADSVKG | DRAYGDYVGWNGFDY |
| M279-D12 | RASQSVSSYLA | DASNRAT | QQRGNWPIT | QYPMW | YIVPSGGRTYYADSVKG | DRAYGDYVGWNGFDY |
| M279-A02 | RASQSVSSYLA | GASNRAT | QQRSNWPIT | QYPMW | YIVPSGGRTYYADSVKG | DRAYGDYVGWNGFDY |
| M287-F03 | RASQSVSSYLA | GASSRAT | QQRSNWPVT | QYPMW | YIVPSGGRTYYADSVKG | DRAYGDYVGWNGFDY |
| M284-F02 | RASQSVSSYLA | GASTRAT | QQRGNWPIT | QYPMW | YIVPSGGRTYYADSVKG | DRAYGDYVGWNGFDY |
| M282-H04 | RASQSVSSYLA | GASNRAT | QQRGNWPPT | QYPMW | YIVPSGGRTYYADSVKG | DRAYGDYVGWNGFDY |
| M278-A08 | RASQSVSSYLA | GASNRAT | EQRRSWPLT | QYPMW | YIVPSGGRTYYADSVKG | DRAYGDYVGWNGFDY |
| M293-C05 | RASRSVGTHLA | DASVRAA | QQRGGWPIT | QYPMW | YIVPSGGRTYYADSVKG | DRAYGDYVGWNGFDY |
| M280-E08 | RASRSVGTHLA | DASVRAA | QQRGNWPIT | QYPMW | YIVPSGGRTYYADSVKG | DRAYGDYVGWNGFDY |
| M287-B07 | RTSQSVSRYLA | GTSNRAT | QQRYNWPIT | QYPMW | YIVPSGGRTYYADSVKG | DRAYGDYVGWNGFDY |
| M280-H10 | RTSQSVSRYLA | GTSNRAT | QQRYNWPIT | QYPMW | YIVPSGGRTYYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M286-E07 | RASQSLSRSDLA | GASNRAT | QQRSNWPIT | QYPMW | YIVPSGGRTYYADSVKG | DRAYGDYVGWNGFDY |
| M280-E12 | RASQSVSSYLA | GASNRAT | QQRSNWPIT | QYPMW | YIVPSGGRTYYADSVKG | DRAYGDYVGWNGFDY |
| M281-A05 | RASQSVGRFLA | GASSRAT | QQRGNWPPT | QYPMW | YIVPSGGRTYYADSVKG | DRAYGDYVGWNGFDY |
| M283-C11 | RASQPVGSYLA | GASNRAT | QQRGNWPLT | QYPMW | YIVPSGGRTYYADSVKG | DRAYGDYVGWNGFDY |
| M279-F07 | RASQSVGYYLA | GASRRAT | QQRSNWPIT | QYPMW | YIVPSGGRTYYADSVKG | DRAYGDYVGWNGFDY |
| M284-H03 | RTSQRVDSNLA | GASTRAT | QQRRKWPVT | QYPMW | YIVPSGGRTYYADSVKG | DRAYGDYVGWNGFDY |
| M295-G08 | RASQSVGSDLA | GASSRAT | QQRGNWPIT | QYPMW | YIVPSGGRTYYADSVKG | DRAYGDYVGWNGFDY |
| M287-E01 | RASQNIGSNLA | GASTRAP | QQRRKWPVT | QYPMW | YIVPSGGRTYYADSVKG | DRAYGDYVGWNGFDY |
| M286-B09 | RASQNIINLA | GASTRAT | QQRSNWPIT | QYPMW | YIVPSGGRTYYADSVKG | DRAYGDYVGWNGFDY |
| M294-A12 | RASHSVGSDLA | GASTRTA | QQRGNWPPT | QYPMW | YIVPSGGRTYYADSVKG | DRAYGDYVGWNGFDY |
| M287-C12 | RASQGVGSDLA | GASSRAT | QQRRSWPPT | QYPMW | YIVPSGGRTYYADSVKG | DRAYGDYVGWNGFDY |
| M290-C09 | RASQNVNRDLA | GASTRAT | QQRGNWPIT | QYPMW | YIVPSGGRTYYADSVKG | DRAYGDYVGWNGFDY |
| M294-C10 | RASQSINSDLA | HTSYRAP | QQRSDWPVT | QYPMW | YIVPSGGRTYYADSVKG | DRAYGDYVGWNGFDY |
| M278-D06 | RASQSISSDLA | GASSRAT | QQRSYWPVT | QYPMW | YIVPSGGRTYYADSVKG | DRAYGDYVGWNGFDY |
| M290-E01 | RASQSISSFLA | DASYRAT | QQRGNWPIT | QYPMW | YIVPSGGRTYYADSVKG | DRAYGDYVGWNGFDY |
| M293-E09 | RASQSVGADLA | HASTRAT | QQRGNWPPT | QYPMW | YIVPSGGRTYYADSVKG | DRAYGDYVGWNGFDY |
| M288-G11 | RASQSVGSDLA | GASHRAT | QQRYNWPIT | QYPMW | YIVPSGGRTYYADSVKG | DRAYGDYVGWNGFDY |
| M284-B09 | RASQSVGSDLA | GASTRAT | QQRGNWPPT | QYPMW | YIVPSGGRTYYADSVKG | DRAYGDYVGWNGFDY |
| M297-A11 | RASQSVGSNLA | GASIRAT | QQRGNWPIT | QYPMW | YIVPSGGRTYYADSVKG | DRAYGDYVGWNGFDY |
| M294-F06 | RASQSVGSNLA | GASTRAT | QQRAYWPVS | QYPMW | YIVPSGGRTYYADSVKG | DRAYGDYVGWNGFDY |
| M295-E02 | RASQSVGSNLA | GASTRAT | QQRGNWPIT | QYPMW | YIVPSGGRTYYADSVKG | DRAYGDYVGWNGFDY |
| M289-H10 | RASQSVGSNLA | GASTRAT | QQRRNWPVT | QYPMW | YIVPSGGRTYYADSVKG | DRAYGDYVGWNGFDY |
| M283-E03 | RASQSVGSQLA | DASTRAT | QQRGNWPIT | QYPMW | YIVPSGGRTYYADSVKG | DRAYGDYVGWNGFDY |
| M279-E12 | RASQSVNSDLA | GASTRAT | QQRGNWPIT | QYPMW | YIVPSGGRTYYADSVKG | DRAYGDYVGWNGFDY |
| M290-A11 | RASQSVNTDLA | GASTRAT | QQRRNWPVT | QYPMW | YIVPSGGRTYYADSVKG | DRAYGDYVGWNGFDY |
| M284-G09 | RASQSVSSDLA | GASTRAT | QQRRKWPVT | QYPMW | YIVPSGGRTYYADSVKG | DRAYGDYVGWNGFDY |
| M281-C06 | RASQSVSSDLA | AASTRAT | QQRSNWPVT | QYPMW | YIVPSGGRTYYADSVKG | DRAYGDYVGWNGFDY |
| M279-C05 | RASQSVSSDLA | HTSYRAP | QQRSDWPVT | QYPMW | YIVPSGGRTYYADSVKG | DRAYGDYVGWNGFDY |
| M293-F04 | RASQSVSSDLA | RASIRAT | QQRGFWPIT | QYPMW | YIVPSGGRTYYADSVKG | DRAYGDYVGWNGFDY |
| M296-G08 | RASQSVSSDLA | RASIRAT | QQRSAWPVT | QYPMW | YIVPSGGRTYYADSVKG | DRAYGDYVGWNGFDY |
| M281-C10 | RASQSVSSDLA | GASTRAT | QQRSNWPPT | QYPMW | YIVPSGGRTYYADSVKG | DRAYGDYVGWNGFDY |
| M281-H10 | RASQSVSSNLA | GASTRAT | QQCYNWPPT | QYPMW | YIVPSGGRTYYADSVKG | DRAYGDYVGWNGFDY |
| M282-E04 | RASQSVSSNLA | GASTRAT | QQRGNWPIT | QYPMW | YIVPSGGRTYYADSVKG | DRAYGDYVGWNGFDY |
| M279-B02 | RASQSVSSNLA | GASTRAT | QQRRNWPVT | QYPMW | YIVPSGGRTYYADSVKG | DRAYGDYVGWNGFDY |
| M286-D09 | RASQSVSSNLA | HASTRAT | QQRGFWPIT | QYPMW | YIVPSGGRTYYADSVKG | DRAYGDYVGWNGFDY |
| M279-F02 | RASQSVSSYLA | GASNTAT | QQRRNWPPT | QYPMW | YIVPSGGRTYYADSVKG | DRAYGDYVGWNGFDY |
| M292-E07 | RASQSVWSNLA | DASYRAT | QQRGNWPIT | QYPMW | YIVPSGGRTYYADSVKG | DRAYGDYVGWNGFDY |
| M284-B10 | RASQTVGTFLA | GASTRAT | QQRSNWPPT | QYPMW | YIVPSGGRTYYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
| --- | --- | --- | --- | --- | --- | --- |
| M297-B06 | RASESVNSDLA | GASTRAT | QQRGSWPIT | QYPMW | YIVPSGGRTYYADSVKG | DRAYGDYVGWNGFDY |
| M280-B02 | RASQNINSDLA | GASTRAT | QQRGGWPIT | QYPMW | YIVPSGGRTYYADSVKG | DRAYGDYVGWNGFDY |
| M279-A03 | KASHSISRNLA | GASTRAT | QQRRNWPVT | QYPMW | YIVPSGGRTYYADSVKG | DRAYGDYVGWNGFDY |
| M280-C09 | RASQTIFGDLA | GASTRAT | QQRSNWPPT | QYPMW | YIVPSGGRTYYADSVKG | DRAYGDYVGWNGFDY |
| M278-H03 | RASRSVSNNVA | EASNRAT | QQRGGWPIT | QYPMW | YIVPSGGRTYYADSVKG | DRAYGDYVGWNGFDY |
| M284-G06 | RASQSVSNYLA | GASNRAT | QQRRSWPPT | QYPMW | YIVPSGGRTYYADSVKG | DRAYGDYVGWNGFDY |
| M284-G01 | RASQSVGSDLA | GASTRAT | QQRSNWPVT | QYPMW | YIVPSGGRTYYADSVKG | DRAYGDYVGWNGFDY |
| M278-H12 | RASQSVNSHVA | EASDRAA | QQRMYWPPT | QYPMW | YIVPSGGRTYYADSVKG | DRAYGDYVGWNGFDY |
| M282-C08 | RASQSLSRSDLA | GASNRAT | QQRSNWPPT | QYPMW | YIVPSGGRTYYADSVKG | DRAYGDYVGWNGFDY |
| M283-C10 | RASQNIGSNLA | GATTRAT | QQRGNWPIT | QYPMW | YIVPSGGRTYYADSVKG | DRAYGDYVGWNGFDY |
| M279-H07 | RASQGINNNLA | DASNRAT | QQRGNWPIT | QYPMW | YIVPSGGRTYYADSVKG | DRAYGDYVGWNGFDY |
| M280-F10 | RASQSVSSDLA | GASNRAT | QQRSKWPIT | QYPMW | YIVPSGGRTYYADSVKG | DRAYGDYVGWNGFDY |
| M281-F01 | RASQSVGSDLA | GASNRAT | QQRSNWPIT | QYPMW | YIVPSGGRTYYADSVKG | DRAYGDYVGWNGFDY |
| M284-F10 | RASQSVGSFLA | GASNRAP | QQRHNWPIT | QYPMW | YIVPSGGRTYYADSVKG | DRAYGDYVGWNGFDY |
| M286-E06 | RASQSVSNYLA | GVSNRAT | QQRGNWPPT | QYPMW | YIVPSGGRTYYADSVKG | DRAYGDYVGWNGFDY |
| M294-G09 | RASQNLGRSDLA | GVSNRAT | QQRSNWPPT | QYPMW | YIVPSGGRTYYADSVKG | DRAYGDYVGWNGFDY |
| M285-H12 | RASQNVHTYLA | EASNRAT | QQRGGWPIT | QYPMW | YIVPSGGRTYYADSVKG | DRAYGDYVGWNGFDY |
| M278-D08 | RASQSISSFLA | DASYRAT | QQRGNWPIT | QYPMW | YIVPSGGRTYYADSVKG | DRAYGDYVGWNGFDY |
| M281-E06 | RASQSLGRGDLA | GASSRAT | QQRSNWPPT | QYPMW | YIVPSGGRTYYADSVKG | DRAYGDYVGWNGFDY |
| M284-A06 | RASQSLGRSDLA | GVSNRVT | QQRSNWPST | QYPMW | YIVPSGGRTYYADSVKG | DRAYGDYVGWNGFDY |
| M283-B06 | RASQSLSGNYLA | GASSRAT | QQRSNWPIT | QYPMW | YIVPSGGRTYYADSVKG | DRAYGDYVGWNGFDY |
| M286-H01 | RASQSVARYLA | GASRRGT | QQRRKWPVT | QYPMW | YIVPSGGRTYYADSVKG | DRAYGDYVGWNGFDY |
| M294-C09 | RASQSVGADLA | HASTRAT | QQRGFWPIT | QYPMW | YIVPSGGRTYYADSVKG | DRAYGDYVGWNGFDY |
| M297-A02 | RASQSVGSDLA | GASTRAT | QQRRSWPPT | QYPMW | YIVPSGGRTYYADSVKG | DRAYGDYVGWNGFDY |
| M283-B05 | RASQSVGSDLA | GTSTRAT | QQRGNWPIT | QYPMW | YIVPSGGRTYYADSVKG | DRAYGDYVGWNGFDY |
| M295-A04 | RASQSVGSNFLA | GASSRAS | QQRSSWPIT | QYPMW | YIVPSGGRTYYADSVKG | DRAYGDYVGWNGFDY |
| M278-D02 | RASQSVNSNLA | EASNRAT | QQRAYWPVS | QYPMW | YIVPSGGRTYYADSVKG | DRAYGDYVGWNGFDY |
| M280-C11 | RASQSVSRHLA | GASNRAT | QQRYNWPIT | QYPMW | YIVPSGGRTYYADSVKG | DRAYGDYVGWNGFDY |
| M281-F10 | RASQSVSSDVA | GASARAT | QQRGNWPIT | QYPMW | YIVPSGGRTYYADSVKG | DRAYGDYVGWNGFDY |
| M297-G08 | RASQSVSSNLA | DASYRAT | QQRGNWPIT | QYPMW | YIVPSGGRTYYADSVKG | DRAYGDYVGWNGFDY |
| M279-G06 | RASQSVSSHLA | GASNRAT | QQRRNWPPT | QYPMW | YIVPSGGRTYYADSVKG | DRAYGDYVGWNGFDY |
| M287-F09 | RASQSVSSSQIA | GASYRAT | QQRSNWPVT | QYPMW | YIVPSGGRTYYADSVKG | DRAYGDYVGWNGFDY |
| M279-C02 | RASQSVSSSQLA | GASNRAT | QQRSRWPIT | QYPMW | YIVPSGGRTYYADSVKG | DRAYGDYVGWNGFDY |
| M287-H12 | RASQSVSSSQLA | GASNRAT | QQRSNWPVT | QYPMW | YIVPSGGRTYYADSVKG | DRAYGDYVGWNGFDY |
| M278-E01 | RASQSVSSSQLA | GASSRAT | QQRGNWPIT | QYPMW | YIVPSGGRTYYADSVKG | DRAYGDYVGWNGFDY |
| M286-D06 | RASQSVSSSQLA | GASNRAT | QQRSNWPVT | QYPMW | YIVPSGGRTYYADSVKG | DRAYGDYVGWNGFDY |
| M283-G08 | RASQSVSSSYLA | DASSRAT | QQRHTWPIT | QYPMW | YIVPSGGRTYYADSVKG | DRAYGDYVGWNGFDY |
| M279-A11 | RASQSVDNHLA | GASTRAT | QQRRKWPVT | QYPMW | YIVPSGGRTYYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M287-C11 | RASQPVGSYLA | GASNRAT | QQRSNWPIT | QYPMW | YIVPSGGRTYYADSVKG | DRAYGDYVGWNGFDY |
| M283-D05 | RASQSLGRSDLA | GVSNRAT | QQRSNWPVT | QYPMW | YIVPSGGRTYYADSVKG | DRAYGDYVGWNGFDY |
| M287-C05 | RASQSVSLYLA | GASSRAT | QQRGSWPIT | QYPMW | YIVPSGGRTYYADSVKG | DRAYGDYVGWNGFDY |
| M294-B11 | RASQDVNRYLA | GASTRAT | QQRSNWPIT | QYPMW | YIVPSGGRTYYADSVKG | DRAYGDYVGWNGFDY |
| M282-G10 | RASQSLNSDLA | GASTRAT | QQRRNWPIT | QYPMW | YIVPSGGRTYYADSVKG | DRAYGDYVGWNGFDY |
| M278-E08 | RASQSVGSDLA | GASTR | QQRGNWPIT | QYPMW | YIVPSGGRTYYADSVKG | DRAYGDYVGWNGFDY |
| M281-H01 | RASQSVSSNLA | GASTRAT | QQRGFWPIT | QYPMW | YIVPSGGRTYYADSVKG | DRAYGDYVGWNGFDY |
| M288-C08 | RASQSVSSYLA | GASTRVT | QQRSSWPIT | QYPMW | YIVPSGGRTYYADSVKG | DRAYGDYVGWNGFDY |
| M287-C07 | RASQTVSSRLLA | AASIRAT | QQRRSWPPT | QYPMW | YIVPSGGRTYYADSVKG | DRAYGDYVGWNGFDY |
| M293-E03 | RATQGIGTFLA | GASTLQS | QQRGNWPIT | QYPMW | YIVPSGGRTYYADSVKG | DRAYGDYVGWNGFDY |
| M286-B08 | RATQGIGTFLA | GASTLQS | QQRGNWPIT | QYPMW | YIVPSGGRTYYADSVKG | DRAYGDYVGWNGFDY |
| M282-D10 | RASQDISSYLA | GASTLQS | QQRGNWPIT | QYPMW | YIVPSGGRTYYADSVKG | DRAYGDYVGWNGFDY |
| M283-C03 | RASQGISSYLA | AASTLQS | QQRSNWPPS | QYPMW | YIVPSGGRTYYADSVKG | DRAYGDYVGWNGFDY |
| M287-G06 | RASQGIRNDVG | APSNLQS | LQDFDFPWT | QYPMW | YIVPSGGRTYYADSVKG | DRAYGDYVGWNGFDY |
| M281-C02 | RASQSISSFLA | DASYRAT | QQRGNWPIT | QYPMW | YIVPSGGRTYYADSVKG | DRAYGDYVGWNGFDY |
| M282-A06 | RASQSVNSDLA | AASTRAT | QQRRKWPVT | QYPMW | YIVPSGGRTYYADSVKG | DRAYGDYVGWNGFDY |
| M280-C07 | RASQGISTWLA | GASNRAT | QQRGNWPIT | QYPMW | YIVPSGGRTYYADSVKG | DRAYGDYVGWNGFDY |
| M287-G10 | RASQTISSWLA | KASSLQS | QQYSSWYT | QYPMW | YIVPSGGRTYYADSVKG | DRAYGDYVGWNGFDY |
| M278-D11 | RASQNVHTYLA | EASNRAT | QQRGGWPIT | QYPMW | YIVPSGGRTYYADSVKG | DRAYGDYVGWNGFDY |
| M287-F02 | RASQNIGSDLA | RASFRAT | QQRGFWPLT | QYPMW | YIVPSGGRTYYADSVKG | DRAYGDYVGWNGFDY |
| M269-C02 | RASQSISSFLA | DASYRAT | QQRGNWPIT | TYPMW | YISSSGGGTYYADSVKG | DRAYGDYVGWNGFDY |
| M277-C02 | RASQSISSFLA | DASYRAT | QQRGNWPIT | AYDMI | YIVPSGGFTDYADSVKG | DRAYGDYVGWNGFDY |
| M272-H08 | RASQSISSFLA | DASYRAT | QQRGNWPIT | AYDMW | VIYPSGGTTFYADSVKG | DRAYGDYVGWNGFDY |
| M271-D10 | RASQSISSFLA | DASYRAT | QQRGNWPIT | AYDMW | VIYSGGMTLYADSVKG | DRAYGDYVGWNGFDY |
| M271-E12 | RASQSISSFLA | DASYRAT | QQRGNWPIT | AYDMW | YISSSGGFTDYADSVKG | DRAYGDYVGWNGFDY |
| M269-C06 | RASQSISSFLA | DASYRAT | QQRGNWPIT | AYEMW | SIYPSGGYTDYADSVKG | DRAYGDYVGWNGFDY |
| M271-G01 | RASQSISSFLA | DASYRAT | QQRGNWPIT | AYEMW | VIYPSGGGTFYADSVKG | DRAYGDYVGWNGFDY |
| M270-F03 | RASQSISSFLA | DASYRAT | QQRGNWPIT | AYMMW | AISPSGGYTGYADSVKG | DRAYGDYVGWNGFDY |
| M270-G04 | RASQSISSFLA | DASYRAT | QQRGNWPIT | AYNMI | YIVPSGGFTGYADSVKG | DRAYGDYVGWNGFDY |
| M268-E01 | RASQSISSFLA | DASYRAT | QQRGNWPIT | AYPMI | YIVPSGGATFYADSVKG | DRAYGDYVGWNGFDY |
| M269-E07 | RASQSISSFLA | DASYRAT | QQRGNWPIT | AYPMM | YIYPSGGGTFYADSVKG | DRAYGDYVGWNGFDY |
| M299-C10 | RASQSISSFLA | DASYRAT | QQRGNWPIT | AYPMW | YIVPSGGMTYYADSVKG | DRAYGDYVGWNGFDY |
| M274-D05 | RASQSISSFLA | DASYRAT | QQRGNWPIT | AYPMW | YIYPSGGATFYADSVKG | DRAYGDYVGWNGFDY |
| M300-F10 | RASQSISSFLA | DASYRAT | QQRGNWPIT | DYAMW | SIYPSGGATFYADSVKG | DRAYGDYVGWNGFDY |
| M269-D11 | RASQSISSFLA | DASYRAT | QQRGNWPIT | DYAMW | WISPSGGGTLYADSVKG | DRAYGDYVGWNGFDY |
| M271-C08 | RASQSISSFLA | DASYRAT | QQRGNWPIT | DYDMF | GIVSSGGYTGYADSVKG | DRAYGDYVGWNGFDY |
| M268-A12 | RASQSISSFLA | DASYRAT | QQRGNWPIT | DYDMW | VISPSGGYTGYADSVKG | DRAYGDYVGWNGFDY |
| M277-A06 | RASQSISSFLA | DASYRAT | QQRGNWPIT | DYDMW | VIYPSGGFTGYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M272-E06 | RASQSISSFLA | DASYRAT | QQRGNWPIT | DYDMW | VIYSGGSTYYADSVKG | DRAYGDYVGWNGFDY |
| M271-A10 | RASQSISSFLA | DASYRAT | QQRGNWPIT | DYDMW | VIYSSGGFTSYADSVKG | DRAYGDYVGWNGFDY |
| M275-E06 | RASQSISSFLA | DASYRAT | QQRGNWPIT | DYDMW | VIYSSGGMTYYADSVKG | DRAYGDYVGWNGFDY |
| M277-E12 | RASQSISSFLA | DASYRAT | QQRGNWPIT | DYMMW | SISPSGGFTDYADSVKG | DRAYGDYVGWNGFDY |
| M269-B06 | RASQSISSFLA | DASYRAT | QQRGNWPIT | DYNMW | VIYPSGGWTMYADSVKG | DRAYGDYVGWNGFDY |
| M271-B04 | RASQSISSFLA | DASYRAT | QQRGNWPIT | DYPMF | YIVPSGGWTDYADSVKG | DRAYGDYVGWNGFDY |
| M306-C02 | RASQSISSFLA | DASYRAT | QQRGNWPIT | DYPMF | YIVPSGGWTSYADSVKG | DRAYGDYVGWNGFDY |
| M277-G06 | RASQSISSFLA | DASYRAT | QQRGNWPIT | DYPMI | YISPSGGYTDYADSVKG | DRAYGDYVGWNGFDY |
| M277-G04 | RASQSISSFLA | DASYRAT | QQRGNWPIT | DYPMI | YIVPSGGWTDYADSVKG | DRAYGDYVGWNGFDY |
| M298-C05 | RASQSISSFLA | DASYRAT | QQRGNWPIT | DYPMI | YIYPSGGGTYYADSVKG | DRAYGDYVGWNGFDY |
| M268-C12 | RASQSISSFLA | DASYRAT | QQRGNWPIT | DYPMW | YISSSGGWTSYADSVKG | DRAYGDYVGWNGFDY |
| M269-F03 | RASQSISSFLA | DASYRAT | QQRGNWPIT | DYPMW | YIYPSGGATYYADSVKG | DRAYGDYVGWNGFDY |
| M271-A08 | RASQSISSFLA | DASYRAT | QQRGNWPIT | DYQMW | VIYPSGGATFYADSVKG | DRAYGDYVGWNGFDY |
| M272-D08 | RASQSISSFLA | DASYRAT | QQRGNWPIT | EYDMW | VIYPSGGPTYYADSVKG | DRAYGDYVGWNGFDY |
| M275-G03 | RASQSISSFLA | DASYRAT | QQRGNWPIT | EYDMW | VIYSSGGYTGYADSVKG | DRAYGDYVGWNGFDY |
| M271-A11 | RASQSISSFLA | DASYRAT | QQRGNWPIT | EYEMW | VIYPSGGYTNYADSVKG | DRAYGDYVGWNGFDY |
| M269-G06 | RASQSISSFLA | DASYRAT | QQRGNWPIT | EYNMW | VIYPSGGPTWYADSVKG | DRAYGDYVGWNGFDY |
| M272-E03 | RASQSISSFLA | DASYRAT | QQRGNWPIT | EYPMF | YISPSGGWTSYADSVKG | DRAYGDYVGWNGFDY |
| M276-G10 | RASQSISSFLA | DASYRAT | QQRGNWPIT | EYPMI | YISPSGGYTGYADSVKG | DRAYGDYVGWNGFDY |
| M269-H08 | RASQSISSFLA | DASYRAT | QQRGNWPIT | EYPMW | SIYPSGGATFYADSVKG | DRAYGDYVGWNGFDY |
| M300-A11 | RASQSISSFLA | DASYRAT | QQRGNWPIT | EYWMW | SISPSGGGTFYADSVKG | DRAYGDYVGWNGFDY |
| M274-D02 | RASQSISSFLA | DASYRAT | QQRGNWPIT | FYDMF | VISSSGGGTFYADSVKG | DRAYGDYVGWNGFDY |
| M269-H01 | RASQSISSFLA | DASYRAT | QQRGNWPIT | FYDML | YISSSGGFTGYADSVKG | DRAYGDYVGWNGFDY |
| M272-D07 | RASQSISSFLA | DASYRAT | QQRGNWPIT | FYDMW | SIYSSGGATFYADSVKG | DRAYGDYVGWNGFDY |
| M271-A12 | RASQSISSFLA | DASYRAT | QQRGNWPIT | FYDMW | VIYSSGGATFYADSVKG | DRAYGDYVGWNGFDY |
| M270-G05 | RASQSISSFLA | DASYRAT | QQRGNWPIT | FYDMW | VIYSSGGFTDYADSVKG | DRAYGDYVGWNGFDY |
| M270-C10 | RASQSISSFLA | DASYRAT | QQRGNWPIT | FYDMW | YISSSGGGTFYADSVKG | DRAYGDYVGWNGFDY |
| M269-D09 | RASQSISSFLA | DASYRAT | QQRGNWPIT | FYDMY | SIVPSGGATFYADSVKG | DRAYGDYVGWNGFDY |
| M277-B07 | RASQSISSFLA | DASYRAT | QQRGNWPIT | FYEMW | YISPSGGGTYYADSVKG | DRAYGDYVGWNGFDY |
| M300-H04 | RASQSISSFLA | DASYRAT | QQRGNWPIT | FYHMI | YIYSSGGTFYADSVKG | DRAYGDYVGWNGFDY |
| M271-H08 | RASQSISSFLA | DASYRAT | QQRGNWPIT | FYMMW | SISPSGGATFYADSVKG | DRAYGDYVGWNGFDY |
| M306-H03 | RASQSISSFLA | DASYRAT | QQRGNWPIT | FYNMW | SISPSGGGTFYADSVKG | DRAYGDYVGWNGFDY |
| M275-F06 | RASQSISSFLA | DASYRAT | QQRGNWPIT | FYNMW | VIYPSGGKTYYADSVKG | DRAYGDYVGWNGFDY |
| M299-C08 | RASQSISSFLA | DASYRAT | QQRGNWPIT | FYNMW | VIYPSGGPTFYADSVKG | DRAYGDYVGWNGFDY |
| M274-D08 | RASQSISSFLA | DASYRAT | QQRGNWPIT | FYPMI | YISPSGGSTLYADSVKG | DRAYGDYVGWNGFDY |
| M303-H07 | RASQSISSFLA | DASYRAT | QQRGNWPIT | FYPMI | YISSSGGFTDYADSVKG | DRAYGDYVGWNGFDY |
| M272-C10 | RASQSISSFLA | DASYRAT | QQRGNWPIT | FYPMI | YISSSGGYTSYADSVKG | DRAYGDYVGWNGFDY |
| M269-C08 | RASQSISSFLA | DASYRAT | QQRGNWPIT | FYPML | YISGGYTGYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M270-F07 | RASQSISSFLA | DASYRAT | QQRGNWPIT | FYPMM | YISFSGGYTGYADSVKG | DRAYGDYVGWNGFDY |
| M273-C10 | RASQSISSFLA | DASYRAT | QQRGNWPIT | FYPMW | YIYPSGGATFYADSVKG | DRAYGDYVGWNGFDY |
| M275-H08 | RASQSISSFLA | DASYRAT | QQRGNWPIT | GYDMW | VISPSGGGTFYADSVKG | DRAYGDYVGWNGFDY |
| M269-C11 | RASQSISSFLA | DASYRAT | QQRGNWPIT | GYDMW | VIYSSGGTTFYADSVKG | DRAYGDYVGWNGFDY |
| M304-B05 | RASQSISSFLA | DASYRAT | QQRGNWPIT | GYNMW | VIYPSGGATFYADSVKG | DRAYGDYVGWNGFDY |
| M276-F12 | RASQSISSFLA | DASYRAT | QQRGNWPIT | GYPMW | YISSSGGTFYADSVKG | DRAYGDYVGWNGFDY |
| M299-D06 | RASQSISSFLA | DASYRAT | QQRGNWPIT | HYAMI | YIVPSGGWTDYADSVKG | DRAYGDYVGWNGFDY |
| M271-G12 | RASQSISSFLA | DASYRAT | QQRGNWPIT | HYAMI | YIVPSGGWTGYADSVKG | DRAYGDYVGWNGFDY |
| M272-G11 | RASQSISSFLA | DASYRAT | QQRGNWPIT | HYDMW | SISPSGGATFYADSVKG | DRAYGDYVGWNGFDY |
| M269-B12 | RASQSISSFLA | DASYRAT | QQRGNWPIT | HYDMW | VIVSSGKTFYADSVKG | DRAYGDYVGWNGFDY |
| M268-A01 | RASQSISSFLA | DASYRAT | QQRGNWPIT | HYDMW | VIYPSGGFTDYADSVKG | DRAYGDYVGWNGFDY |
| M277-B12 | RASQSISSFLA | DASYRAT | QQRGNWPIT | HYDMW | VIYPSGGHTLYADSVKG | DRAYGDYVGWNGFDY |
| M273-G07 | RASQSISSFLA | DASYRAT | QQRGNWPIT | HYDMW | VIYPSGGPTYYADSVKG | DRAYGDYVGWNGFDY |
| M274-F01 | RASQSISSFLA | DASYRAT | QQRGNWPIT | HYDMW | VIYPSGGVTYYADSVKG | DRAYGDYVGWNGFDY |
| M275-E12 | RASQSISSFLA | DASYRAT | QQRGNWPIT | HYDMW | VIYSSGGFTGYADSVKG | DRAYGDYVGWNGFDY |
| M298-E01 | RASQSISSFLA | DASYRAT | QQRGNWPIT | HYDMW | VIYSSGGPTYYADSVKG | DRAYGDYVGWNGFDY |
| M274-G10 | RASQSISSFLA | DASYRAT | QQRGNWPIT | HYDMW | YISPSGGFTSYADSVKG | DRAYGDYVGWNGFDY |
| M268-G01 | RASQSISSFLA | DASYRAT | QQRGNWPIT | HYEMW | SISSSGGGTFYADSVKG | DRAYGDYVGWNGFDY |
| M269-H02 | RASQSISSFLA | DASYRAT | QQRGNWPIT | HYEMW | YIGSSGGSTYYADSVKG | DRAYGDYVGWNGFDY |
| M277-G05 | RASQSISSFLA | DASYRAT | QQRGNWPIT | HYMMI | GISPSGGYTGYADSVKG | DRAYGDYVGWNGFDY |
| M271-H01 | RASQSISSFLA | DASYRAT | QQRGNWPIT | HYMMW | SIYPSGGGTYYADSVKG | DRAYGDYVGWNGFDY |
| M303-F06 | RASQSISSFLA | DASYRAT | QQRGNWPIT | HYMMW | SIYPSGGTYYADSVKG | DRAYGDYVGWNGFDY |
| M272-B03 | RASQSISSFLA | DASYRAT | QQRGNWPIT | HYPMF | YISSSGGWTDYADSVKG | DRAYGDYVGWNGFDY |
| M272-B04 | RASQSISSFLA | DASYRAT | QQRGNWPIT | HYPMI | YISPSGGGTFYADSVKG | DRAYGDYVGWNGFDY |
| M272-H03 | RASQSISSFLA | DASYRAT | QQRGNWPIT | HYPMI | YISSSGGGTFYADSVKG | DRAYGDYVGWNGFDY |
| M274-G12 | RASQSISSFLA | DASYRAT | QQRGNWPIT | HYPMI | YIYSSGGGTFYADSVKG | DRAYGDYVGWNGFDY |
| M274-F02 | RASQSISSFLA | DASYRAT | QQRGNWPIT | HYPML | YIYPSGGGTFYADSVKG | DRAYGDYVGWNGFDY |
| M276-H11 | RASQSISSFLA | DASYRAT | QQRGNWPIT | HYPMM | YISSSGGYTGYADSVKG | DRAYGDYVGWNGFDY |
| M303-C04 | RASQSISSFLA | DASYRAT | QQRGNWPIT | HYPMM | YIYSSGGGTYYADSVKG | DRAYGDYVGWNGFDY |
| M276-G09 | RASQSISSFLA | DASYRAT | QQRGNWPIT | HYPMV | YISPSGGYTGYADSVKG | DRAYGDYVGWNGFDY |
| M298-D05 | RASQSISSFLA | DASYRAT | QQRGNWPIT | HYPMW | SISPSGGATFYADSVKG | DRAYGDYVGWNGFDY |
| M305-G05 | RASQSISSFLA | DASYRAT | QQRGNWPIT | HYPMW | VIYSSGGGTFYADSVKG | DRAYGDYVGWNGFDY |
| M269-D03 | RASQSISSFLA | DASYRAT | QQRGNWPIT | HYPMW | WIVPSGGFTLYADSVKG | DRAYGDYVGWNGFDY |
| M275-A08 | RASQSISSFLA | DASYRAT | QQRGNWPIT | HYPMW | YIHPSGGGTLYADSVKG | DRAYGDYVGWNGFDY |
| M299-A12 | RASQSISSFLA | DASYRAT | QQRGNWPIT | HYPMW | YISSSGGGTFYADSVKG | DRAYGDYVGWNGFDY |
| M302-D10 | RASQSISSFLA | DASYRAT | QQRGNWPIT | HYPMW | YIVPSGGATFYADSVKG | DRAYGDYVGWNGFDY |
| M272-H12 | RASQSISSFLA | DASYRAT | QQRGNWPIT | HYPMW | YIYPSGGGTYYADSVKG | DRAYGDYVGWNGFDY |
| M304-G08 | RASQSISSFLA | DASYRAT | QQRGNWPIT | HYQMW | SISSSGGGTYYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M298-A01 | RASQSISSFLA | DASYRAT | QQRGNWPIT | HYSMM | YISPSGGYTGYADSVKG | DRAYGDYVGWNGFDY |
| M272-E07 | RASQSISSFLA | DASYRAT | QQRGNWPIT | HYSMW | VIYPSGGATFYADSVKG | DRAYGDYVGWNGFDY |
| M268-F03 | RASQSISSFLA | DASYRAT | QQRGNWPIT | IYDMW | VISPSGGSTYYADSVKG | DRAYGDYVGWNGFDY |
| M268-B08 | RASQSISSFLA | DASYRAT | QQRGNWPIT | IYDMW | VIYPSGGATWYADSVKG | DRAYGDYVGWNGFDY |
| M271-A03 | RASQSISSFLA | DASYRAT | QQRGNWPIT | IYDMW | VIYPSGGPTFYADSVKG | DRAYGDYVGWNGFDY |
| M270-G02 | RASQSISSFLA | DASYRAT | QQRGNWPIT | IYDMW | VIYPSGGVTFYADSVKG | DRAYGDYVGWNGFDY |
| M277-H05 | RASQSISSFLA | DASYRAT | QQRGNWPIT | IYDMW | VIYSSGGFTGYADSVKG | DRAYGDYVGWNGFDY |
| M273-F04 | RASQSISSFLA | DASYRAT | QQRGNWPIT | IYPMI | YISPSGGYTSYADSVKG | DRAYGDYVGWNGFDY |
| M268-G10 | RASQSISSFLA | DASYRAT | QQRGNWPIT | IYPMW | YISPSGGFTSYADSVKG | DRAYGDYVGWNGFDY |
| M300-F01 | RASQSISSFLA | DASYRAT | QQRGNWPIT | IYPMW | YISPSGGGTYYADSVKG | DRAYGDYVGWNGFDY |
| M273-H03 | RASQSISSFLA | DASYRAT | QQRGNWPIT | IYPMW | YISSSGGWTDYADSVKG | DRAYGDYVGWNGFDY |
| M277-C11 | RASQSISSFLA | DASYRAT | QQRGNWPIT | IYPMW | YIVPSGGMTYYADSVKG | DRAYGDYVGWNGFDY |
| M273-G06 | RASQSISSFLA | DASYRAT | QQRGNWPIT | IYPMW | YIYPSGGGTFYADSVKG | DRAYGDYVGWNGFDY |
| M273-B10 | RASQSISSFLA | DASYRAT | QQRGNWPIT | KYAMI | WIPPSGGYTSYADSVKG | DRAYGDYVGWNGFDY |
| M272-F08 | RASQSISSFLA | DASYRAT | QQRGNWPIT | KYAMI | YISPSGGFTGYADSVKG | DRAYGDYVGWNGFDY |
| M270-G12 | RASQSISSFLA | DASYRAT | QQRGNWPIT | KYAMI | YISSSGGFTDYADSVKG | DRAYGDYVGWNGFDY |
| M274-H05 | RASQSISSFLA | DASYRAT | QQRGNWPIT | KYAMW | SISPSGGGTFYADSVKG | DRAYGDYVGWNGFDY |
| M271-F05 | RASQSISSFLA | DASYRAT | QQRGNWPIT | KYAMW | YIVPSGGRTFYADSVKG | DRAYGDYVGWNGFDY |
| M273-H08 | RASQSISSFLA | DASYRAT | QQRGNWPIT | KYDMF | SIVPSGGATYYADSVKG | DRAYGDYVGWNGFDY |
| M271-H02 | RASQSISSFLA | DASYRAT | QQRGNWPIT | KYDMI | WIGPSGGATMYADSVKG | DRAYGDYVGWNGFDY |
| M306-A12 | RASQSISSFLA | DASYRAT | QQRGNWPIT | KYDMI | YIGSSGGYTGYADSVKG | DRAYGDYVGWNGFDY |
| M271-B06 | RASQSISSFLA | DASYRAT | QQRGNWPIT | KYDMW | SISSSGGGTFYADSVKG | DRAYGDYVGWNGFDY |
| M271-D01 | RASQSISSFLA | DASYRAT | QQRGNWPIT | KYDMW | VIYPSGGPTFYADSVKG | DRAYGDYVGWNGFDY |
| M269-H03 | RASQSISSFLA | DASYRAT | QQRGNWPIT | KYDMW | VIYPSGGQTYYADSVKG | DRAYGDYVGWNGFDY |
| M274-E01 | RASQSISSFLA | DASYRAT | QQRGNWPIT | KYDMW | VIYPSGGSTYYADSVKG | DRAYGDYVGWNGFDY |
| M275-B12 | RASQSISSFLA | DASYRAT | QQRGNWPIT | KYDMW | VIYSSGGFTLYADSVKG | DRAYGDYVGWNGFDY |
| M270-H06 | RASQSISSFLA | DASYRAT | QQRGNWPIT | KYDMW | VIYSSGGFTSYADSVKG | DRAYGDYVGWNGFDY |
| M271-A04 | RASQSISSFLA | DASYRAT | QQRGNWPIT | KYDMW | VIYSSGGPTFYADSVKG | DRAYGDYVGWNGFDY |
| M272-C09 | RASQSISSFLA | DASYRAT | QQRGNWPIT | KYDMW | YIGPSGGFTDYADSVKG | DRAYGDYVGWNGFDY |
| M274-G09 | RASQSISSFLA | DASYRAT | QQRGNWPIT | KYDMW | YISSSGGFTDYADSVKG | DRAYGDYVGWNGFDY |
| M299-F05 | RASQSISSFLA | DASYRAT | QQRGNWPIT | KYDMW | YIVPSGGFIDYADSVKG | DRAYGDYVGWNGFDY |
| M275-B05 | RASQSISSFLA | DASYRAT | QQRGNWPIT | KYEMF | SISSSGGGTFYADSVKG | DRAYGDYVGWNGFDY |
| M271-H04 | RASQSISSFLA | DASYRAT | QQRGNWPIT | KYEMW | VIYPSGGMTYYADSVKG | DRAYGDYVGWNGFDY |
| M277-D11 | RASQSISSFLA | DASYRAT | QQRGNWPIT | KYEMW | VIYPSGGYTGYADSVKG | DRAYGDYVGWNGFDY |
| M268-B02 | RASQSISSFLA | DASYRAT | QQRGNWPIT | KYEMW | VIYSSGGKTYYADSVKG | DRAYGDYVGWNGFDY |
| M275-E04 | RASQSISSFLA | DASYRAT | QQRGNWPIT | KYEMW | YIGPSGGFTDYADSVKG | DRAYGDYVGWNGFDY |
| M275-D12 | RASQSISSFLA | DASYRAT | QQRGNWPIT | KYEMW | YIGPSGGITMYADSVKG | DRAYGDYVGWNGFDY |
| M270-A02 | RASQSISSFLA | DASYRAT | QQRGNWPIT | KYEMW | YISPSGGGTLYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M277-F09 | RASQSISSFLA | DASYRAT | QQRGNWPIT | KYMMF | SIYSSGGRTFYADSVKG | DRAYGDYVGWNGFDY |
| M269-G12 | RASQSISSFLA | DASYRAT | QQRGNWPIT | KYNMW | SIYPSGGATFYADSVKG | DRAYGDYVGWNGFDY |
| M273-G04 | RASQSISSFLA | DASYRAT | QQRGNWPIT | KYNMW | VIYPSGGATFYADSVKG | DRAYGDYVGWNGFDY |
| M269-G04 | RASQSISSFLA | DASYRAT | QQRGNWPIT | KYPMF | YIVPSGGYTSYADSVKG | DRAYGDYVGWNGFDY |
| M269-B01 | RASQSISSFLA | DASYRAT | QQRGNWPIT | KYPMI | YISPSGGYTGYADSVKG | DRAYGDYVGWNGFDY |
| M268-B06 | RASQSISSFLA | DASYRAT | QQRGNWPIT | KYPMI | YISPSGGYTSYADSVKG | DRAYGDYVGWNGFDY |
| M272-A11 | RASQSISSFLA | DASYRAT | QQRGNWPIT | KYPMI | YISSSGGWTDYADSVKG | DRAYGDYVGWNGFDY |
| M274-H02 | RASQSISSFLA | DASYRAT | QQRGNWPIT | KYPMI | YIYPSGGATYYADSVKG | DRAYGDYVGWNGFDY |
| M275-C12 | RASQSISSFLA | DASYRAT | QQRGNWPIT | KYPMI | YIYPSGGYTSYADSVKG | DRAYGDYVGWNGFDY |
| M268-G12 | RASQSISSFLA | DASYRAT | QQRGNWPIT | KYPMI | YIYSSGGGTYYADSVKG | DRAYGDYVGWNGFDY |
| M271-C02 | RASQSISSFLA | DASYRAT | QQRGNWPIT | KYPMM | YISPSGGFTDYADSVKG | DRAYGDYVGWNGFDY |
| M268-E09 | RASQSISSFLA | DASYRAT | QQRGNWPIT | KYPMM | YIYPSGGYTDYADSVKG | DRAYGDYVGWNGFDY |
| M274-F09 | RASQSISSFLA | DASYRAT | QQRGNWPIT | KYPMM | YIYPSGGYTGYADSVKG | DRAYGDYVGWNGFDY |
| M271-F02 | RASQSISSFLA | DASYRAT | QQRGNWPIT | KYPMW | SIVSSGGATYYTDSVKG | DRAYGDYVGWNGFDY |
| M276-B12 | RASQSISSFLA | DASYRAT | QQRGNWPIT | KYPMW | SIYPSGGYTGYADSVKG | DRAYGDYVGWNGFDY |
| M272-H09 | RASQSISSFLA | DASYRAT | QQRGNWPIT | KYPMW | VISPSGGATYYADSVKG | DRAYGDYVGWNGFDY |
| M272-G02 | RASQSISSFLA | DASYRAT | QQRGNWPIT | KYPMW | VIYPSGGYTAYADSVKG | DRAYGDYVGWNGFDY |
| M274-E04 | RASQSISSFLA | DASYRAT | QQRGNWPIT | KYPMW | VIYSGGGTFYADSVKG | DRAYGDYVGWNGFDY |
| M303-B07 | RASQSISSFLA | DASYRAT | QQRGNWPIT | KYPMW | YISPSGGGTLYADSVKG | DRAYGDYVGWNGFDY |
| M275-D06 | RASQSISSFLA | DASYRAT | QQRGNWPIT | KYPMW | YISPSGGGTYYADSVKG | DRAYGDYVGWNGFDY |
| M271-D04 | RASQSISSFLA | DASYRAT | QQRGNWPIT | KYPMW | YISSSGGGTYYADSVKG | DRAYGDYVGWNGFDY |
| M268-H03 | RASQSISSFLA | DASYRAT | QQRGNWPIT | KYPMW | YIVPSGGATFYADSVKG | DRAYGDYVGWNGFDY |
| M272-A03 | RASQSISSFLA | DASYRAT | QQRGNWPIT | KYPMW | YIVPSGGPTWYADSVKG | DRAYGDYVGWNGFDY |
| M274-G07 | RASQSISSFLA | DASYRAT | QQRGNWPIT | KYPMW | YIVPSGGWTAYADSVKG | DRAYGDYVGWNGFDY |
| M270-E01 | RASQSISSFLA | DASYRAT | QQRGNWPIT | KYQMW | SIYPSGGATFYADSVKG | DRAYGDYVGWNGFDY |
| M270-G09 | RASQSISSFLA | DASYRAT | QQRGNWPIT | KYQMW | SIYPSGGGTFYADSVKG | DRAYGDYVGWNGFDY |
| M272-B11 | RASQSISSFLA | DASYRAT | QQRGNWPIT | KYSMI | YIVPSGGYTGYADSVKG | DRAYGDYVGWNGFDY |
| M268-C03 | RASQSISSFLA | DASYRAT | QQRGNWPIT | KYSMW | SIYPSGGATFYADSVKG | DRAYGDYVGWNGFDY |
| M270-E10 | RASQSISSFLA | DASYRAT | QQRGNWPIT | KYSMW | VIYPSGGATFYADSVKG | DRAYGDYVGWNGFDY |
| M305-F06 | RASQSISSFLA | DASYRAT | QQRGNWPIT | KYSMW | VIYPSGGFTDYADSVKG | DRAYGDYVGWNGFDY |
| M270-H04 | RASQSISSFLA | DASYRAT | QQRGNWPIT | KYTMW | VIYPSGGATFYADSVKG | DRAYGDYVGWNGFDY |
| M269-D05 | RASQSISSFLA | DASYRAT | QQRGNWPIT | KYWMW | VIVPSGGMTYYADSVKG | DRAYGDYVGWNGFDY |
| M270-F02 | RASQSISSFLA | DASYRAT | QQRGNWPIT | KYYMW | SIYSSGGGTFYADSVKG | DRAYGDYVGWNGFDY |
| M275-D07 | RASQSISSFLA | DASYRAT | QQRGNWPIT | LYAMI | YISPSGGFTGYADSVKG | DRAYGDYVGWNGFDY |
| M273-E12 | RASQSISSFLA | DASYRAT | QQRGNWPIT | LYAMW | SIVPSGGKTYYADSVKG | DRAYGDYVGWNGFDY |
| M273-A09 | RASQSISSFLA | DASYRAT | QQRGNWPIT | LYAMW | YIYPSGGGTYYADSVKG | DRAYGDYVGWNGFDY |
| M271-G03 | RASQSISSFLA | DASYRAT | QQRGNWPIT | LYDML | YIYPSGGFTGYADSVKG | DRAYGDYVGWNGFDY |
| M299-F01 | RASQSISSFLA | DASYRAT | QQRGNWPIT | LYDMV | WIGPSGGLTIYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M274-A03 | RASQSISSFLA | DASYRAT | QQRGNWPIT | LYDMW | SISSSGGYTGYADSVKG | DRAYGDYVGWNGFDY |
| M276-B04 | RASQSISSFLA | DASYRAT | QQRGNWPIT | LYDMW | VIRPSGGSTYYADSVKG | DRAYGDYVGWNGFDY |
| M269-B10 | RASQSISSFLA | DASYRAT | QQRGNWPIT | LYDMW | VIYPSGGPTYYADSVKG | DRAYGDYVGWNGFDY |
| M270-A05 | RASQSISSFLA | DASYRAT | QQRGNWPIT | LYDMW | VIYSSGGATFYADSVKG | DRAYGDYVGWNGFDY |
| M268-B11 | RASQSISSFLA | DASYRAT | QQRGNWPIT | LYDMW | VIYSSGGTTFYADSVKG | DRAYGDYVGWNGFDY |
| M272-F10 | RASQSISSFLA | DASYRAT | QQRGNWPIT | LYDMW | VIYSSGGYTAYADSVKG | DRAYGDYVGWNGFDY |
| M307-F04 | RASQSISSFLA | DASYRAT | QQRGNWPIT | LYDMW | VIYSSGGYTGYADSVKG | DRAYGDYVGWNGFDY |
| M274-F08 | RASQSISSFLA | DASYRAT | QQRGNWPIT | LYDMW | YIGPSGGNTLYADSVKG | DRAYGDYVGWNGFDY |
| M275-D11 | RASQSISSFLA | DASYRAT | QQRGNWPIT | LYEMW | VISPGGGTYYADSVKG | DRAYGDYVGWNGFDY |
| M269-B03 | RASQSISSFLA | DASYRAT | QQRGNWPIT | LYEMW | YISSSGGGTLYADSVKG | DRAYGDYVGWNGFDY |
| M269-F10 | RASQSISSFLA | DASYRAT | QQRGNWPIT | LYMMW | SIYPSGGTYYADSVKG | DRAYGDYVGWNGFDY |
| M306-E11 | RASQSISSFLA | DASYRAT | QQRGNWPIT | LYNMW | VIYPSGGYTGYADSVKG | DRAYGDYVGWNGFDY |
| M271-B12 | RASQSISSFLA | DASYRAT | QQRGNWPIT | LYPMI | YISPSGGFTDYADSVKG | DRAYGDYVGWNGFDY |
| M304-E07 | RASQSISSFLA | DASYRAT | QQRGNWPIT | LYPMM | YIYPSGGGTFYADSVKG | DRAYGDYVGWNGFDY |
| M268-H02 | RASQSISSFLA | DASYRAT | QQRGNWPIT | LYPMW | SISPSGGATFYADSVKG | DRAYGDYVGWNGFDY |
| M301-B03 | RASQSISSFLA | DASYRAT | QQRGNWPIT | LYPMW | SISPSGGGTFYADSVKG | DRAYGDYVGWNGFDY |
| M306-D04 | RASQSISSFLA | DASYRAT | QQRGNWPIT | LYPMW | SIYPSGGATFYADSVKG | DRAYGDYVGWNGFDY |
| M270-D05 | RASQSISSFLA | DASYRAT | QQRGNWPIT | LYPMW | VIYSSGGATFYADSVKG | DRAYGDYVGWNGFDY |
| M269-C07 | RASQSISSFLA | DASYRAT | QQRGNWPIT | LYPMW | WIVPSGGFTLYADSVKG | DRAYGDYVGWNGFDY |
| M269-G10 | RASQSISSFLA | DASYRAT | QQRGNWPIT | LYPMW | YISPSGGGTLYADSVKG | DRAYGDYVGWNGFDY |
| M274-A12 | RASQSISSFLA | DASYRAT | QQRGNWPIT | LYPMW | YISSSGGGTYYADSVKG | DRAYGDYVGWNGFDY |
| M272-B10 | RASQSISSFLA | DASYRAT | QQRGNWPIT | LYPMW | YIVPSGGGTFYADSVKG | DRAYGDYVGWNGFDY |
| M302-A05 | RASQSISSFLA | DASYRAT | QQRGNWPIT | LYPMW | YIVSSGGATFYADSVKG | DRAYGDYVGWNGFDY |
| M273-D07 | RASQSISSFLA | DASYRAT | QQRGNWPIT | LYPMW | YIYPSGGATMYADSVKG | DRAYGDYVGWNGFDY |
| M274-C03 | RASQSISSFLA | DASYRAT | QQRGNWPIT | LYQMW | VIYPSGGATYYADSVKG | DRAYGDYVGWNGFDY |
| M272-E09 | RASQSISSFLA | DASYRAT | QQRGNWPIT | LYQMW | VIYPSGGTFYADSVKG | DRAYGDYVGWNGFDY |
| M298-G03 | RASQSISSFLA | DASYRAT | QQRGNWPIT | MYDMW | VISPSGGGTFYADSVKG | DRAYGDYVGWNGFDY |
| M268-E04 | RASQSISSFLA | DASYRAT | QQRGNWPIT | MYDMW | VIYPSGGNTLYADSVKG | DRAYGDYVGWNGFDY |
| M270-A08 | RASQSISSFLA | DASYRAT | QQRGNWPIT | MYDMW | VIYPSGGPTFYADSVKG | DRAYGDYVGWNGFDY |
| M268-C07 | RASQSISSFLA | DASYRAT | QQRGNWPIT | MYDMW | VIYPSGGYTAYADSVKG | DRAYGDYVGWNGFDY |
| M268-F02 | RASQSISSFLA | DASYRAT | QQRGNWPIT | MYDMW | VIYSSGGFTDYADSVKG | DRAYGDYVGWNGFDY |
| M271-A05 | RASQSISSFLA | DASYRAT | QQRGNWPIT | MYDMW | VIYSSGGPTFYADSVKG | DRAYGDYVGWNGFDY |
| M270-C12 | RASQSISSFLA | DASYRAT | QQRGNWPIT | MYDMW | VIYSSGGVTFYADSVKG | DRAYGDYVGWNGFDY |
| M272-A02 | RASQSISSFLA | DASYRAT | QQRGNWPIT | MYDMW | VIYSSGGYTAYADSVKG | DRAYGDYVGWNGFDY |
| M299-F03 | RASQSISSFLA | DASYRAT | QQRGNWPIT | MYDMW | VIYSSGGYTDYADSVKG | DRAYGDYVGWNGFDY |
| M272-F05 | RASQSISSFLA | DASYRAT | QQRGNWPIT | MYDMW | VIYSSGGYTNYADSVKG | DRAYGDYVGWNGFDY |
| M301-D12 | RASQSISSFLA | DASYRAT | QQRGNWPIT | MYDMW | VIYSSGGYTSYADSVKG | DRAYGDYVGWNGFDY |
| M276-B10 | RASQSISSFLA | DASYRAT | QQRGNWPIT | MYDMW | YISSSGGSTLYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M270-B05 | RASQSISSFLA | DASYRAT | QQRGNWPIT | MYMMI | SIYPSGGFTSYADSVKG | DRAYGDYVGWNGFDY |
| M277-E11 | RASQSISSFLA | DASYRAT | QQRGNWPIT | MYNMW | SISPSGGATYYADSVKG | DRAYGDYVGWNGFDY |
| M304-E02 | RASQSISSFLA | DASYRAT | QQRGNWPIT | MYPII | YISPSGGFTGYADSVKG | DRAYGDYVGWNGFDY |
| M307-E12 | RASQSISSFLA | DASYRAT | QQRGNWPIT | MYPMF | YISPSGGWTAYADSVKG | DRAYGDYVGWNGFDY |
| M271-H07 | RASQSISSFLA | DASYRAT | QQRGNWPIT | MYPMF | YISPSGGWTDYADSVKG | DRAYGDYVGWNGFDY |
| M274-C01 | RASQSISSFLA | DASYRAT | QQRGNWPIT | MYPMF | YIVPSGGWTDYADSVKG | DRAYGDYVGWNGFDY |
| M268-D03 | RASQSISSFLA | DASYRAT | QQRGNWPIT | MYPMI | YISPSGGGTFYADSVKG | DRAYGDYVGWNGFDY |
| M272-H01 | RASQSISSFLA | DASYRAT | QQRGNWPIT | MYPMI | YIVPSGGFTGYADSVKG | DRAYGDYVGWNGFDY |
| M302-B06 | RASQSISSFLA | DASYRAT | QQRGNWPIT | MYPML | YISPSGGYTGYADSVKG | DRAYGDYVGWNGFDY |
| M270-B11 | RASQSISSFLA | DASYRAT | QQRGNWPIT | MYPMT | YISPSGGYTGYADSVKG | DRAYGDYVGWNGFDY |
| M277-A10 | RASQSISSFLA | DASYRAT | QQRGNWPIT | MYSMW | VIYPSGGFTDYADSVKG | DRAYGDYVGWNGFDY |
| M302-G12 | RASQSISSFLA | DASYRAT | QQRGNWPIT | MYWML | YISPSGGGTFYADSVKG | DRAYGDYVGWNGFDY |
| M276-C01 | RASQSISSFLA | DASYRAT | QQRGNWPIT | MYWMW | SISSSGGYTGYADSVKG | DRAYGDYVGWNGFDY |
| M276-E07 | RASQSISSFLA | DASYRAT | QQRGNWPIT | NYAMW | YISPSGATYYADSVKG | DRAYGDYVGWNGFDY |
| M268-C06 | RASQSISSFLA | DASYRAT | QQRGNWPIT | NYAMW | YISPSGGSTYYADSVKG | DRAYGDYVGWNGFDY |
| M273-F02 | RASQSISSFLA | DASYRAT | QQRGNWPIT | NYDMA | WISSSGGFTDYADSVKG | DRAYGDYVGWNGFDY |
| M270-B01 | RASQSISSFLA | DASYRAT | QQRGNWPIT | NYDMI | VISPSGGWTSYADSVKG | DRAYGDYVGWNGFDY |
| M276-G04 | RASQSISSFLA | DASYRAT | QQRGNWPIT | NYDMI | YIVPSGGYTAYADSVKG | DRAYGDYVGWNGFDY |
| M270-H01 | RASQSISSFLA | DASYRAT | QQRGNWPIT | NYDMW | VISPSGGFTGYADSVKG | DRAYGDYVGWNGFDY |
| M270-A10 | RASQSISSFLA | DASYRAT | QQRGNWPIT | NYDMW | VISSSGGYTYADSVKG | DRAYGDYVGWNGFDY |
| M269-A01 | RASQSISSFLA | DASYRAT | QQRGNWPIT | NYDMW | VISSSGMTYYADSVKG | DRAYGDYVGWNGFDY |
| M271-E06 | RASQSISSFLA | DASYRAT | QQRGNWPIT | NYDMW | VIVPSGGATYYADSVKG | DRAYGDYVGWNGFDY |
| M271-F01 | RASQSISSFLA | DASYRAT | QQRGNWPIT | NYDMW | VIYPSGGATFYADSVKG | DRAYGDYVGWNGFDY |
| M271-E04 | RASQSISSFLA | DASYRAT | QQRGNWPIT | NYDMW | VIYPSGGITYYADSVKG | DRAYGDYVGWNGFDY |
| M305-H10 | RASQSISSFLA | DASYRAT | QQRGNWPIT | NYDMW | VIYPSGGITYYADSVKG | DRAYGDYVGWNGFDY |
| M272-D03 | RASQSISSFLA | DASYRAT | QQRGNWPIT | NYDMW | VIYPSGGYTVYADSVKG | DRAYGDYVGWNGFDY |
| M270-E12 | RASQSISSFLA | DASYRAT | QQRGNWPIT | NYDMW | VIYSGGPTYYADSVKG | DRAYGDYVGWNGFDY |
| M299-A04 | RASQSISSFLA | DASYRAT | QQRGNWPIT | NYDMW | VIYSSGGYTAYADSVKG | DRAYGDYVGWNGFDY |
| M269-C03 | RASQSISSFLA | DASYRAT | QQRGNWPIT | NYDMW | WISSSGGATIYADSVKG | DRAYGDYVGWNGFDY |
| M274-E09 | RASQSISSFLA | DASYRAT | QQRGNWPIT | NYDMW | YISSSGGATLYADSVKG | DRAYGDYVGWNGFDY |
| M269-E04 | RASQSISSFLA | DASYRAT | QQRGNWPIT | NYEMW | VIYSSGSATFYADSVKG | DRAYGDYVGWNGFDY |
| M271-F07 | RASQSISSFLA | DASYRAT | QQRGNWPIT | NYIMW | SIYPSGGATLYADSVKG | DRAYGDYVGWNGFDY |
| M272-F12 | RASQSISSFLA | DASYRAT | QQRGNWPIT | NYMMI | SIYPSGGYTGYADSVKG | DRAYGDYVGWNGFDY |
| M272-C01 | RASQSISSFLA | DASYRAT | QQRGNWPIT | NYMMI | SIYSSGGFTSYADSVKG | DRAYGDYVGWNGFDY |
| M275-B11 | RASQSISSFLA | DASYRAT | QQRGNWPIT | NYMMW | SIGPSGGGTFYADSVKG | DRAYGDYVGWNGFDY |
| M275-F12 | RASQSISSFLA | DASYRAT | QQRGNWPIT | NYMMW | SIYSGGGTFYADSVKG | DRAYGDYVGWNGFDY |
| M268-C10 | RASQSISSFLA | DASYRAT | QQRGNWPIT | NYMMW | VISPSGGATYYADSVKG | DRAYGDYVGWNGFDY |
| M303-C05 | RASQSISSFLA | DASYRAT | QQRGNWPIT | NYNMM | YISSSGGYTGYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M274-E08 | RASQSISSFLA | DASYRAT | QQRGNWPIT | NYNMW | VIYPSGGPTFYADSVKG | DRAYGDYVGWNGFDY |
| M276-D12 | RASQSISSFLA | DASYRAT | QQRGNWPIT | NYNMW | YISPSGGGTLYADSVKG | DRAYGDYVGWNGFDY |
| M299-A02 | RASQSISSFLA | DASYRAT | QQRGNWPIT | NYPMF | YISPSGGWTSYADSVKG | DRAYGDYVGWNGFDY |
| M268-C05 | RASQSISSFLA | DASYRAT | QQRGNWPIT | NYPMI | YISPSGGGTFYADSVKG | DRAYGDYVGWNGFDY |
| M276-H10 | RASQSISSFLA | DASYRAT | QQRGNWPIT | NYPMI | YISSSGGYTGYADSVKG | DRAYGDYVGWNGFDY |
| M270-F10 | RASQSISSFLA | DASYRAT | QQRGNWPIT | NYPMI | YIVPSGGFTSYADSVKG | DRAYGDYVGWNGFDY |
| M271-F12 | RASQSISSFLA | DASYRAT | QQRGNWPIT | NYPMI | YIYPSGGGTYYADSVKG | DRAYGDYVGWNGFDY |
| M301-H08 | RASQSISSFLA | DASYRAT | QQRGNWPIT | NYPMI | YIYPSGGTFYADSVKG | DRAYGDYVGWNGFDY |
| M304-D02 | RASQSISSFLA | DASYRAT | QQRGNWPIT | NYPMW | SISPSGGSTYYADSVKG | DRAYGDYVGWNGFDY |
| M268-G02 | RASQSISSFLA | DASYRAT | QQRGNWPIT | NYPMW | SIVPSGGATYYADSVKG | DRAYGDYVGWNGFDY |
| M271-D07 | RASQSISSFLA | DASYRAT | QQRGNWPIT | NYPMW | SIYPSGGATFYADSVKG | DRAYGDYVGWNGFDY |
| M269-F06 | RASQSISSFLA | DASYRAT | QQRGNWPIT | NYPMW | SIYPSGGKATYYADSVKG | DRAYGDYVGWNGFDY |
| M271-H11 | RASQSISSFLA | DASYRAT | QQRGNWPIT | NYPMW | SIYPSGGPTFYADSVKG | DRAYGDYVGWNGFDY |
| M275-F05 | RASQSISSFLA | DASYRAT | QQRGNWPIT | NYPMW | SIYSSGGATFYADSVKG | DRAYGDYVGWNGFDY |
| M300-H06 | RASQSISSFLA | DASYRAT | QQRGNWPIT | NYPMW | VIYPSGGYTAYADSVKG | DRAYGDYVGWNGFDY |
| M274-B07 | RASQSISSFLA | DASYRAT | QQRGNWPIT | NYPMW | YIGPSGGGTLYADSVKG | DRAYGDYVGWNGFDY |
| M269-A07 | RASQSISSFLA | DASYRAT | QQRGNWPIT | NYPMW | YIRPSGGPTWYADSVKG | DRAYGDYVGWNGFDY |
| M269-H04 | RASQSISSFLA | DASYRAT | QQRGNWPIT | NYPMW | YISPSGGGTFYADSVKG | DRAYGDYVGWNGFDY |
| M306-H02 | RASQSISSFLA | DASYRAT | QQRGNWPIT | NYPMW | YISPSGGGTLYADSVKG | DRAYGDYVGWNGFDY |
| M299-C09 | RASQSISSFLA | DASYRAT | QQRGNWPIT | NYPMW | YIVPSGGATFYADSVKG | DRAYGDYVGWNGFDY |
| M274-D06 | RASQSISSFLA | DASYRAT | QQRGNWPIT | NYPMW | YIVPSGGMTYYADSVKG | DRAYGDYVGWNGFDY |
| M303-C12 | RASQSISSFLA | DASYRAT | QQRGNWPIT | NYSMW | VIYPSGGYTSYADSVKG | DRAYGDYVGWNGFDY |
| M273-D11 | RASQSISSFLA | DASYRAT | QQRGNWPIT | NYYMI | YISPSGGGTYYADSVKG | DRAYGDYVGWNGFDY |
| M268-G04 | RASQSISSFLA | DASYRAT | QQRGNWPIT | PYAMW | YISSSGGGTFYADSVKG | DRAYGDYVGWNGFDY |
| M299-D01 | RASQSISSFLA | DASYRAT | QQRGNWPIT | PYDMW | VISPSGGATFYADSVKG | DRAYGDYVGWNGFDY |
| M303-G04 | RASQSISSFLA | DASYRAT | QQRGNWPIT | PYDMW | VISPSGGYTGYADSVKG | DRAYGDYVGWNGFDY |
| M271-C05 | RASQSISSFLA | DASYRAT | QQRGNWPIT | PYDMW | VISSSGGFTDYADSVKG | DRAYGDYVGWNGFDY |
| M271-F04 | RASQSISSFLA | DASYRAT | QQRGNWPIT | PYMMF | SISSSGGGTFYADSVKG | DRAYGDYVGWNGFDY |
| M275-E05 | RASQSISSFLA | DASYRAT | QQRGNWPIT | PYMMI | SISSSGGYTGYADSVKG | DRAYGDYVGWNGFDY |
| M269-H12 | RASQSISSFLA | DASYRAT | QQRGNWPIT | PYMMS | SIYSSGGATFYADSVKG | DRAYGDYVGWNGFDY |
| M270-C02 | RASQSISSFLA | DASYRAT | QQRGNWPIT | PYMMW | SISSSGGGTFYADSVKG | DRAYGDYVGWNGFDY |
| M272-F09 | RASQSISSFLA | DASYRAT | QQRGNWPIT | PYNMW | VIYPSGGATFYADSVKG | DRAYGDYVGWNGFDY |
| M275-F04 | RASQSISSFLA | DASYRAT | QQRGNWPIT | PYPMF | SISPSGGATYYADSVKG | DRAYGDYVGWNGFDY |
| M305-G11 | RASQSISSFLA | DASYRAT | QQRGNWPIT | PYPMI | YIGSSGGYTSYADSVKG | DRAYGDYVGWNGFDY |
| M269-C10 | RASQSISSFLA | DASYRAT | QQRGNWPIT | PYPMI | YISPSGGFTDYADSVKG | DRAYGDYVGWNGFDY |
| M277-A04 | RASQSISSFLA | DASYRAT | QQRGNWPIT | PYPMI | YISPSGGGTFYADSVKG | DRAYGDYVGWNGFDY |
| M274-G05 | RASQSISSFLA | DASYRAT | QQRGNWPIT | PYPMI | YISSSGGGTYYADSVKG | DRAYGDYVGWNGFDY |
| M271-F10 | RASQSISSFLA | DASYRAT | QQRGNWPIT | PYPMI | YISSSGGYTDYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M301-E12 | RASQSISSFLA | DASYRAT | QQRGNWPIT | PYPMW | YISPSGGWTDYADSVKG | DRAYGDYVGWNGFDY |
| M271-C03 | RASQSISSFLA | DASYRAT | QQRGNWPIT | PYPMW | YIVPSGGKTFYADSVKG | DRAYGDYVGWNGFDY |
| M274-C08 | RASQSISSFLA | DASYRAT | QQRGNWPIT | QYAMI | YISPSGGYTGYADSVKG | DRAYGDYVGWNGFDY |
| M274-G04 | RASQSISSFLA | DASYRAT | QQRGNWPIT | QYDMI | YIGSSGGSTIYADSVKG | DRAYGDYVGWNGFDY |
| M274-B05 | RASQSISSFLA | DASYRAT | QQRGNWPIT | QYDMW | VISPSGGHTSYADSVKG | DRAYGDYVGWNGFDY |
| M270-D11 | RASQSISSFLA | DASYRAT | QQRGNWPIT | QYDMW | VISSSGGATWYADSVKG | DRAYGDYVGWNGFDY |
| M276-A01 | RASQSISSFLA | DASYRAT | QQRGNWPIT | QYDMW | VIYPSGGPTFYADSVKG | DRAYGDYVGWNGFDY |
| M269-F11 | RASQSISSFLA | DASYRAT | QQRGNWPIT | QYDMW | VIYPSGGTTFYADSVKG | DRAYGDYVGWNGFDY |
| M276-B07 | RASQSISSFLA | DASYRAT | QQRGNWPIT | QYDMW | VIYPSGGYTDYADSVKG | DRAYGDYVGWNGFDY |
| M275-D03 | RASQSISSFLA | DASYRAT | QQRGNWPIT | QYDMW | VIYPSGTTFYADSVKG | DRAYGDYVGWNGFDY |
| M268-F07 | RASQSISSFLA | DASYRAT | QQRGNWPIT | QYDMW | YIVPSGGFTDYADSVKG | DRAYGDYVGWNGFDY |
| M268-H01 | RASQSISSFLA | DASYRAT | QQRGNWPIT | QYGMW | YIYPSGGGTYYADSVKG | DRAYGDYVGWNGFDY |
| M271-B11 | RASQSISSFLA | DASYRAT | QQRGNWPIT | QYMMI | YIVPSGGTTGYADSVKG | DRAYGDYVGWNGFDY |
| M270-H12 | RASQSISSFLA | DASYRAT | QQRGNWPIT | QYPMF | YIVPSGGYTSYADSVKG | DRAYGDYVGWNGFDY |
| M273-C06 | RASQSISSFLA | DASYRAT | QQRGNWPIT | QYPMI | YIVPSGGWTSYADSVKG | DRAYGDYVGWNGFDY |
| M277-F05 | RASQSISSFLA | DASYRAT | QQRGNWPIT | QYPMM | YIYPSGGATYYADSVKG | DRAYGDYVGWNGFDY |
| M273-C12 | RASQSISSFLA | DASYRAT | QQRGNWPIT | QYPMM | YIYPSGGGTYYADSVKG | DRAYGDYVGWNGFDY |
| M275-F11 | RASQSISSFLA | DASYRAT | QQRGNWPIT | QYPMW | SISPSGGATYYADSVKG | DRAYGDYVGWNGFDY |
| M268-C02 | RASQSISSFLA | DASYRAT | QQRGNWPIT | QYPMW | SIYPSGGGTFYADSVKG | DRAYGDYVGWNGFDY |
| M269-D01 | RASQSISSFLA | DASYRAT | QQRGNWPIT | QYPMW | SIYSSGGATYYADSVKG | DRAYGDYVGWNGFDY |
| M270-C06 | RASQSISSFLA | DASYRAT | QQRGNWPIT | QYPMW | VIYPSGGFTSYADSVKG | DRAYGDYVGWNGFDY |
| M270-D09 | RASQSISSFLA | DASYRAT | QQRGNWPIT | QYPMW | VIYPSGGYTGYADSVKG | DRAYGDYVGWNGFDY |
| M275-F07 | RASQSISSFLA | DASYRAT | QQRGNWPIT | QYQMW | VIYPSGGATYYADSVKG | DRAYGDYVGWNGFDY |
| M277-D10 | RASQSISSFLA | DASYRAT | QQRGNWPIT | QYSMI | YIVPSGGYTSYADSVKG | DRAYGDYVGWNGFDY |
| M275-E02 | RASQSISSFLA | DASYRAT | QQRGNWPIT | QYSMW | SIVPSGGATFYADSVKG | DRAYGDYVGWNGFDY |
| M274-H10 | RASQSISSFLA | DASYRAT | QQRGNWPIT | QYSMW | VIYSSGGATFYADSVKG | DRAYGDYVGWNGFDY |
| M271-C06 | RASQSISSFLA | DASYRAT | QQRGNWPIT | QYSMW | VIYSSGSATFYADSVKG | DRAYGDYVGWNGFDY |
| M272-C06 | RASQSISSFLA | DASYRAT | QQRGNWPIT | QYWMW | VISSSGGGTYYADSVKG | DRAYGDYVGWNGFDY |
| M274-C02 | RASQSISSFLA | DASYRAT | QQRGNWPIT | QYWMW | VIVPSGGKTFYADSVKG | DRAYGDYVGWNGFDY |
| M274-G01 | RASQSISSFLA | DASYRAT | QQRGNWPIT | RYAMI | YISPSGGFTDYADSVKG | DRAYGDYVGWNGFDY |
| M268-F12 | RASQSISSFLA | DASYRAT | QQRGNWPIT | RYAMM | YISPSGGFTDYADSVKG | DRAYGDYVGWNGFDY |
| M268-F11 | RASQSISSFLA | DASYRAT | QQRGNWPIT | RYAMW | SIYPSGGGTFYADSVKG | DRAYGDYVGWNGFDY |
| M299-E06 | RASQSISSFLA | DASYRAT | QQRGNWPIT | RYAMW | YIVPSGGYTDYADSVKG | DRAYGDYVGWNGFDY |
| M273-B12 | RASQSISSFLA | DASYRAT | QQRGNWPIT | RYDMF | SISPSGGGTYYADSVKG | DRAYGDYVGWNGFDY |
| M298-A04 | RASQSISSFLA | DASYRAT | QQRGNWPIT | RYDMW | SISSSGGFTGYADSVKG | DRAYGDYVGWNGFDY |
| M273-A11 | RASQSISSFLA | DASYRAT | QQRGNWPIT | RYDMW | VISPSGGATFYADSVKG | DRAYGDYVGWNGFDY |
| M269-A05 | RASQSISSFLA | DASYRAT | QQRGNWPIT | RYDMW | VIYPSGGHTMYADSVKG | DRAYGDYVGWNGFDY |
| M270-C05 | RASQSISSFLA | DASYRAT | QQRGNWPIT | RYDMW | WISPSGGGTQYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
|---|---|---|---|---|---|---|
| M269-F05 | RASQSISSFLA | DASYRAT | QQRGNWPIT | RYDMW | YIVPSGGFTSYADSVKG | DRAYGDYVGWNGFDY |
| M277-H07 | RASQSISSFLA | DASYRAT | QQRGNWPIT | RYHMW | YISPSGGSTLYADSVKG | DRAYGDYVGWNGFDY |
| M275-A06 | RASQSISSFLA | DASYRAT | QQRGNWPIT | RYMMI | GIYPSGGWTDYADSVKG | DRAYGDYVGWNGFDY |
| M268-B10 | RASQSISSFLA | DASYRAT | QQRGNWPIT | RYNMW | VIYPSGGATYYADSVKG | DRAYGDYVGWNGFDY |
| M270-H03 | RASQSISSFLA | DASYRAT | QQRGNWPIT | RYPMF | YISPSGGYTSYADSVKG | DRAYGDYVGWNGFDY |
| M276-A02 | RASQSISSFLA | DASYRAT | QQRGNWPIT | RYPMF | YIVPSGGYTDYADSVKG | DRAYGDYVGWNGFDY |
| M304-C09 | RASQSISSFLA | DASYRAT | QQRGNWPIT | RYPMI | YIYPSGGGTYYADSVKG | DRAYGDYVGWNGFDY |
| M271-B05 | RASQSISSFLA | DASYRAT | QQRGNWPIT | RYPMV | YISPSGGYTGYADSVKG | DRAYGDYVGWNGFDY |
| M270-C04 | RASQSISSFLA | DASYRAT | QQRGNWPIT | RYPMW | SISSSGGGTYYADSVKG | DRAYGDYVGWNGFDY |
| M268-G08 | RASQSISSFLA | DASYRAT | QQRGNWPIT | RYPMW | SIYPSGGATFYADSVKG | DRAYGDYVGWNGFDY |
| M269-E08 | RASQSISSFLA | DASYRAT | QQRGNWPIT | RYPMW | VIYPSGGATYYADSVKG | DRAYGDYVGWNGFDY |
| M276-F02 | RASQSISSFLA | DASYRAT | QQRGNWPIT | RYPMW | VIYPSGGTTFYADSVKG | DRAYGDYVGWNGFDY |
| M276-A10 | RASQSISSFLA | DASYRAT | QQRGNWPIT | RYPMW | VIYSSGGYTGYADSVKG | DRAYGDYVGWNGFDY |
| M304-D03 | RASQSISSFLA | DASYRAT | QQRGNWPIT | RYPMW | YIGSSGGGTFYADSVKG | DRAYGDYVGWNGFDY |
| M271-D11 | RASQSISSFLA | DASYRAT | QQRGNWPIT | RYPMW | YISPSGGGTLYADSVKG | DRAYGDYVGWNGFDY |
| M272-A08 | RASQSISSFLA | DASYRAT | QQRGNWPIT | RYPMW | YISPSGGMTSYADSVKG | DRAYGDYVGWNGFDY |
| M269-B07 | RASQSISSFLA | DASYRAT | QQRGNWPIT | RYPMW | YISSSGGGTFYADSVKG | DRAYGDYVGWNGFDY |
| M271-G08 | RASQSISSFLA | DASYRAT | QQRGNWPIT | RYPMW | YISSSGGGTLYADSVKG | DRAYGDYVGWNGFDY |
| M271-A02 | RASQSISSFLA | DASYRAT | QQRGNWPIT | RYPMW | YIVPSGGATYYADSVKG | DRAYGDYVGWNGFDY |
| M273-G11 | RASQSISSFLA | DASYRAT | QQRGNWPIT | RYPMW | YIVPSGGFTDYAHSVKG | DRAYGDYVGWNGFDY |
| M299-B04 | RASQSISSFLA | DASYRAT | QQRGNWPIT | RYPMW | YIVPSGGTTYYADSVKG | DRAYGDYVGWNGFDY |
| M275-E08 | RASQSISSFLA | DASYRAT | QQRGNWPIT | RYPMW | YIYPSGGATFYADSVKG | DRAYGDYVGWNGFDY |
| M275-B08 | RASQSISSFLA | DASYRAT | QQRGNWPIT | RYPMW | YIYSSGGKTFYADSVKG | DRAYGDYVGWNGFDY |
| M277-G09 | RASQSISSFLA | DASYRAT | QQRGNWPIT | RYSMW | SIYPSGGATFYADSVKG | DRAYGDYVGWNGFDY |
| M271-E01 | RASQSISSFLA | DASYRAT | QQRGNWPIT | RYSMW | VIYPSGGYTGYADSVKG | DRAYGDYVGWNGFDY |
| M275-F09 | RASQSISSFLA | DASYRAT | QQRGNWPIT | RYWMW | VIVPSGGATFYADSVKG | DRAYGDYVGWNGFDY |
| M269-D08 | RASQSISSFLA | DASYRAT | QQRGNWPIT | RYYMM | YISPSGGATYYADSVKG | DRAYGDYVGWNGFDY |
| M277-C12 | RASQSISSFLA | DASYRAT | QQRGNWPIT | SYDMI | WIGPSGGSTMYADSVKG | DRAYGDYVGWNGFDY |
| M274-F12 | RASQSISSFLA | DASYRAT | QQRGNWPIT | SYDMW | SISSSVGATYYADSVKG | DRAYGDYVGWNGFDY |
| M269-G01 | RASQSISSFLA | DASYRAT | QQRGNWPIT | SYDMW | VIGPSGGGTFYADSVKG | DRAYGDYVGWNGFDY |
| M269-F04 | RASQSISSFLA | DASYRAT | QQRGNWPIT | SYDMW | VISPSGGYTGYADSVKG | DRAYGDYVGWNGFDY |
| M269-E01 | RASQSISSFLA | DASYRAT | QQRGNWPIT | SYDMW | VIYPSGGRTYYADSVKG | DRAYGDYVGWNGFDY |
| M269-G07 | RASQSISSFLA | DASYRAT | QQRGNWPIT | SYDMW | VIYSSGGFTGYADSVKG | DRAYGDYVGWNGFDY |
| M268-C01 | RASQSISSFLA | DASYRAT | QQRGNWPIT | SYDMW | VIYSSGGTTFYADSVKG | DRAYGDYVGWNGFDY |
| M268-D06 | RASQSISSFLA | DASYRAT | QQRGNWPIT | SYDMW | VIYSSGGYTGYADSVKG | DRAYGDYVGWNGFDY |
| M272-G07 | RASQSISSFLA | DASYRAT | QQRGNWPIT | SYEMW | VIYSSGGATFYADSVKG | DRAYGDYVGWNGFDY |
| M303-F07 | RASQSISSFLA | DASYRAT | QQRGNWPIT | SYEMW | YISSSGGGTYYADSVKG | DRAYGDYVGWNGFDY |
| M275-B02 | RASQSISSFLA | DASYRAT | QQRGNWPIT | SYMMI | SISPSGGGTYYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
| --- | --- | --- | --- | --- | --- | --- |
| M269-C01 | RASQSISSFLA | DASYRAT | QQRGNWPIT | SYMMI | SISPSGGWTSYADSVKG | DRAYGDYVGWNGFDY |
| M268-H04 | RASQSISSFLA | DASYRAT | QQRGNWPIT | SYMMI | SIYPSGGYTSYADSVKG | DRAYGDYVGWNGFDY |
| M277-H08 | RASQSISSFLA | DASYRAT | QQRGNWPIT | SYNMW | SISPSGGGTYYADSVKG | DRAYGDYVGWNGFDY |
| M274-B02 | RASQSISSFLA | DASYRAT | QQRGNWPIT | SYPMI | YISSSGGFTDYADSVKG | DRAYGDYVGWNGFDY |
| M268-E03 | RASQSISSFLA | DASYRAT | QQRGNWPIT | SYPMM | YIYSSGGGTFYADSVKG | DRAYGDYVGWNGFDY |
| M302-G11 | RASQSISSFLA | DASYRAT | QQRGNWPIT | SYPMW | SISPSGGGTYYADSVKG | DRAYGDYVGWNGFDY |
| M270-G08 | RASQSISSFLA | DASYRAT | QQRGNWPIT | SYPMW | SISPSGMTYYADSVKG | DRAYGDYVGWNGFDY |
| M268-E08 | RASQSISSFLA | DASYRAT | QQRGNWPIT | SYPMW | SIYPSGGGTFYADSVKG | DRAYGDYVGWNGFDY |
| M270-E05 | RASQSISSFLA | DASYRAT | QQRGNWPIT | SYPMW | YISSSGGGTYYADSVKG | DRAYGDYVGWNGFDY |
| M271-A01 | RASQSISSFLA | DASYRAT | QQRGNWPIT | SYPMW | YIVPSGGATFYADSVKG | DRAYGDYVGWNGFDY |
| M270-C03 | RASQSISSFLA | DASYRAT | QQRGNWPIT | SYPMW | YIVPSGGSTLYADSVKG | DRAYGDYVGWNGFDY |
| M275-A09 | RASQSISSFLA | DASYRAT | QQRGNWPIT | SYPMW | YIVPSGGYTYYADSVKG | DRAYGDYVGWNGFDY |
| M298-D08 | RASQSISSFLA | DASYRAT | QQRGNWPIT | SYQMW | SIYPSGGATFYADSVKG | DRAYGDYVGWNGFDY |
| M274-A09 | RASQSISSFLA | DASYRAT | QQRGNWPIT | SYSMW | VIYSSGGYTGYADSVKG | DRAYGDYVGWNGFDY |
| M269-E06 | RASQSISSFLA | DASYRAT | QQRGNWPIT | TYAMI | YIGPSGGFTDYADSVKG | DRAYGDYVGWNGFDY |
| M269-H06 | RASQSISSFLA | DASYRAT | QQRGNWPIT | TYAMW | YISPSGGGTFYADSVKG | DRAYGDYVGWNGFDY |
| M276-E11 | RASQSISSFLA | DASYRAT | QQRGNWPIT | TYDMF | SISSSGGATFYADSVKG | DRAYGDYVGWNGFDY |
| M271-E11 | RASQSISSFLA | DASYRAT | QQRGNWPIT | TYDMI | YISPSGGYTGYADSVKG | DRAYGDYVGWNGFDY |
| M270-A04 | RASQSISSFLA | DASYRAT | QQRGNWPIT | TYDMI | YISSSGGFTDYADSVKG | DRAYGDYVGWNGFDY |
| M268-F10 | RASQSISSFLA | DASYRAT | QQRGNWPIT | TYDMW | VIYPSGGPTYYADSVKG | DRAYGDYVGWNGFDY |
| M275-A02 | RASQSISSFLA | DASYRAT | QQRGNWPIT | TYDMW | YISSSGGGTFYADSVKG | DRAYGDYVGWNGFDY |
| M272-C08 | RASQSISSFLA | DASYRAT | QQRGNWPIT | TYEMW | YISSSGGGTGYADSVKG | DRAYGDYVGWNGFDY |
| M277-F06 | RASQSISSFLA | DASYRAT | QQRGNWPIT | TYPMF | YISPSGGYTDYADSVKG | DRAYGDYVGWNGFDY |
| M272-B07 | RASQSISSFLA | DASYRAT | QQRGNWPIT | TYPMI | YIVPSGGYTGYADSVKG | DRAYGDYVGWNGFDY |
| M276-E12 | RASQSISSFLA | DASYRAT | QQRGNWPIT | TYPMM | YIYPSGGATFYADSVKG | DRAYGDYVGWNGFDY |
| M299-D12 | RASQSISSFLA | DASYRAT | QQRGNWPIT | TYPMW | SISPSGGATYYADSVKG | DRAYGDYVGWNGFDY |
| M273-F01 | RASQSISSFLA | DASYRAT | QQRGNWPIT | TYPMW | SIVPSGGATYYADSVKG | DRAYGDYVGWNGFDY |
| M271-C07 | RASQSISSFLA | DASYRAT | QQRGNWPIT | TYPMW | VIYSSGGYTGYADSVKG | DRAYGDYVGWNGFDY |
| M269-H10 | RASQSISSFLA | DASYRAT | QQRGNWPIT | TYPMW | YISPSGGATFYADSVKG | DRAYGDYVGWNGFDY |
| M268-B07 | RASQSISSFLA | DASYRAT | QQRGNWPIT | TYPMW | YISPSGGGTFYADSVKG | DRAYGDYVGWNGFDY |
| M277-G07 | RASQSISSFLA | DASYRAT | QQRGNWPIT | TYPMW | YIVPSGGYTDYADSVKG | DRAYGDYVGWNGFDY |
| M273-F06 | RASQSISSFLA | DASYRAT | QQRGNWPIT | TYPMW | YIYPSGGGTFYADSVKG | DRAYGDYVGWNGFDY |
| M274-E07 | RASQSISSFLA | DASYRAT | QQRGNWPIT | TYQMW | SIYSSGGTFYADSVKG | DRAYGDYVGWNGFDY |
| M276-F04 | RASQSISSFLA | DASYRAT | QQRGNWPIT | TYSMI | YISPSGGFTDYADSVKG | DRAYGDYVGWNGFDY |
| M270-A06 | RASQSISSFLA | DASYRAT | QQRGNWPIT | VYDMI | YIGPSGGMTLYADSVKG | DRAYGDYVGWNGFDY |
| M274-G08 | RASQSISSFLA | DASYRAT | QQRGNWPIT | VYDMW | VIYPSGGATYYADSVKG | DRAYGDYVGWNGFDY |
| M274-D12 | RASQSISSFLA | DASYRAT | QQRGNWPIT | VYDMW | VIYPSGGYTDYADSVKG | DRAYGDYVGWNGFDY |
| M304-E10 | RASQSISSFLA | DASYRAT | QQRGNWPIT | VYDMW | VIYSSGGATFYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
| --- | --- | --- | --- | --- | --- | --- |
| M268-A02 | RASQSISSFLA | DASYRAT | QQRGNWPIT | VYDMW | VIYSSGGPTFYADSVKG | DRAYGDYVGWNGFDY |
| M272-B06 | RASQSISSFLA | DASYRAT | QQRGNWPIT | VYDMW | YISPSGGFTDYADSVKG | DRAYGDYVGWNGFDY |
| M268-D04 | RASQSISSFLA | DASYRAT | QQRGNWPIT | VYEMW | YISPSGGGTFYADSVKG | DRAYGDYVGWNGFDY |
| M298-G07 | RASQSISSFLA | DASYRAT | QQRGNWPIT | VYNMW | SISPSGGGTFYADSVKG | DRAYGDYVGWNGFDY |
| M276-E09 | RASQSISSFLA | DASYRAT | QQRGNWPIT | VYPMW | SISPSGGATYYADSVKG | DRAYGDYVGWNGFDY |
| M269-B04 | RASQSISSFLA | DASYRAT | QQRGNWPIT | VYPMW | SISPSGGYTGYADSVKG | DRAYGDYVGWNGFDY |
| M299-D07 | RASQSISSFLA | DASYRAT | QQRGNWPIT | VYPMW | SISSGGATYYADSVKG | DRAYGDYVGWNGFDY |
| M304-G02 | RASQSISSFLA | DASYRAT | QQRGNWPIT | VYPMW | WISPSGGGTFYADSVKG | DRAYGDYVGWNGFDY |
| M268-D05 | RASQSISSFLA | DASYRAT | QQRGNWPIT | VYPMW | WISSSGGGTAYADSVKG | DRAYGDYVGWNGFDY |
| M275-G10 | RASQSISSFLA | DASYRAT | QQRGNWPIT | VYPMW | YIVPSGGATYYADSVKG | DRAYGDYVGWNGFDY |
| M276-G02 | RASQSISSFLA | DASYRAT | QQRGNWPIT | VYPMW | YIYPSGGATYYADSVKG | DRAYGDYVGWNGFDY |
| M274-D10 | RASQSISSFLA | DASYRAT | QQRGNWPIT | VYQMW | VIYPSGGTTFYADSVKG | DRAYGDYVGWNGFDY |
| M274-E12 | RASQSISSFLA | DASYRAT | QQRGNWPIT | VYWMI | YISPSGGGTFYADSVKG | DRAYGDYVGWNGFDY |
| M301-A06 | RASQSISSFLA | DASYRAT | QQRGNWPIT | WYAMW | SISPSGGGTYYADSVKG | DRAYGDYVGWNGFDY |
| M268-F01 | RASQSISSFLA | DASYRAT | QQRGNWPIT | WYDMF | SISPSGGATFYADSVKG | DRAYGDYVGWNGFDY |
| M268-D08 | RASQSISSFLA | DASYRAT | QQRGNWPIT | WYDMW | VIYPSGGATYYADSVKG | DRAYGDYVGWNGFDY |
| M268-B04 | RASQSISSFLA | DASYRAT | QQRGNWPIT | WYDMW | VIYPSGGFTDYADSVKG | DRAYGDYVGWNGFDY |
| M270-B04 | RASQSISSFLA | DASYRAT | QQRGNWPIT | WYDMW | VIYPSGGYTGYADSVKG | DRAYGDYVGWNGFDY |
| M268-D07 | RASQSISSFLA | DASYRAT | QQRGNWPIT | WYDMW | VIYSSGGATFYADSVKG | DRAYGDYVGWNGFDY |
| M276-F11 | RASQSISSFLA | DASYRAT | QQRGNWPIT | WYDMW | VIYSSGGPTFYADSVKG | DRAYGDYVGWNGFDY |
| M274-D03 | RASQSISSFLA | DASYRAT | QQRGNWPIT | WYEMW | WISPSGGGTQYADSVKG | DRAYGDYVGWNGFDY |
| M274-H06 | RASQSISSFLA | DASYRAT | QQRGNWPIT | WYEMW | YISPSGGGTYYADSVKG | DRAYGDYVGWNGFDY |
| M270-D07 | RASQSISSFLA | DASYRAT | QQRGNWPIT | WYNMW | VIYPSGGGTFYADSVKG | DRAYGDYVGWNGFDY |
| M274-F11 | RASQSISSFLA | DASYRAT | QQRGNWPIT | WYNMW | YIVSSGGFTDYADSVKG | DRAYGDYVGWNGFDY |
| M275-B07 | RASQSISSFLA | DASYRAT | QQRGNWPIT | WYPMI | YISSSGGYTSYADSVKG | DRAYGDYVGWNGFDY |
| M274-C07 | RASQSISSFLA | DASYRAT | QQRGNWPIT | WYPMT | YISPSGGYTGYADSVKG | DRAYGDYVGWNGFDY |
| M275-H02 | RASQSISSFLA | DASYRAT | QQRGNWPIT | WYPMV | YIYPSGGGTFYADSVKG | DRAYGDYVGWNGFDY |
| M276-B06 | RASQSISSFLA | DASYRAT | QQRGNWPIT | WYPMW | SISPSGGATYYADSVKG | DRAYGDYVGWNGFDY |
| M305-H03 | RASQSISSFLA | DASYRAT | QQRGNWPIT | WYPMW | SIVPSGGATYYADSVKG | DRAYGDYVGWNGFDY |
| M272-G03 | RASQSISSFLA | DASYRAT | QQRGNWPIT | WYPMW | VIYPSGGYTSYADSVKG | DRAYGDYVGWNGFDY |
| M268-G05 | RASQSISSFLA | DASYRAT | QQRGNWPIT | WYPMW | VIYSSGGATFYADSVKG | DRAYGDYVGWNGFDY |
| M303-H08 | RASQSISSFLA | DASYRAT | QQRGNWPIT | WYPMW | VIYSSGGYTGYADSVKG | DRAYGDYVGWNGFDY |
| M271-C10 | RASQSISSFLA | DASYRAT | QQRGNWPIT | WYPMW | YIVPSGGATFYADSVKG | DRAYGDYVGWNGFDY |
| M274-B03 | RASQSISSFLA | DASYRAT | QQRGNWPIT | WYPMW | YIVPSGGRTYYADSVKG | DRAYGDYVGWNGFDY |
| M277-B08 | RASQSISSFLA | DASYRAT | QQRGNWPIT | WYSMW | VIYPSGGGTFYADSVKG | DRAYGDYVGWNGFDY |
| M273-D09 | RASQSISSFLA | DASYRAT | QQRGNWPIT | WYTMW | SISPSGGGTYYADSVKG | DRAYGDYVGWNGFDY |
| M273-C04 | RASQSISSFLA | DASYRAT | QQRGNWPIT | WYYMI | YISPSGGGTYYADSVKG | DRAYGDYVGWNGFDY |
| M275-H04 | RASQSISSFLA | DASYRAT | QQRGNWPIT | YYDMI | WISPSGGLTMYADSVKG | DRAYGDYVGWNGFDY |

TABLE 5-continued

CDRs of 627 hMMP2/hMMP9/mMMP2/mMMP9-inhibiting Abs

| Initial Name | LV-CDR1 | LV-CDR2 | LV-CDR3 | HV-CDR1 | HV-CDR2 | HV-CDR3 |
| --- | --- | --- | --- | --- | --- | --- |
| M271-G11 | RASQSISSFLA | DASYRAT | QQRGNWPIT | YYDMI | YIVPSGGYTSYADSVKG | DRAYGDYVGWNGFDY |
| M271-F08 | RASQSISSFLA | DASYRAT | QQRGNWPIT | YYDMV | YISPSGGFTLYADSVKG | DRAYGDYVGWNGFDY |
| M268-D01 | RASQSISSFLA | DASYRAT | QQRGNWPIT | YYDMW | SISPSGGFTGYADSVKG | DRAYGDYVGWNGFDY |
| M304-E11 | RASQSISSFLA | DASYRAT | QQRGNWPIT | YYDMW | VISSSGGGTFYADSVKG | DRAYGDYVGWNGFDY |
| M301-B04 | RASQSISSFLA | DASYRAT | QQRGNWPIT | YYDMW | VIYPSGGTTFYADSVKG | DRAYGDYVGWNGFDY |
| M301-A09 | RASQSISSFLA | DASYRAT | QQRGNWPIT | YYDMW | VIYPSGGYTAYADSVKG | DRAYGDYVGWNGFDY |
| M268-H12 | RASQSISSFLA | DASYRAT | QQRGNWPIT | YYDMW | YISSSGGGTYYADSVKG | DRAYGDYVGWNGFDY |
| M273-H09 | RASQSISSFLA | DASYRAT | QQRGNWPIT | YYEMW | YISSSGGFTSYADSVKG | DRAYGDYVGWNGFDY |
| M303-A02 | RASQSISSFLA | DASYRAT | QQRGNWPIT | YYGMW | VISPSGGGTFYADSVKG | DRAYGDYVGWNGFDY |
| M273-G09 | RASQSISSFLA | DASYRAT | QQRGNWPIT | YYMMI | GIVSGGFTMYADSVKG | DRAYGDYVGWNGFDY |
| M274-A08 | RASQSISSFLA | DASYRAT | QQRGNWPIT | YYMMW | SISSSGGGTFYADSVKG | DRAYGDYVGWNGFDY |
| M268-H06 | RASQSISSFLA | DASYRAT | QQRGNWPIT | YYMMW | SIYSSGGATFYADSVKG | DRAYGDYVGWNGFDY |
| M273-F05 | RASQSISSFLA | DASYRAT | QQRGNWPIT | YYNMW | SISPSGGGTYYADSVKG | DRAYGDYVGWNGFDY |
| M268-E02 | RASQSISSFLA | DASYRAT | QQRGNWPIT | YYPMF | YISPSGGWTDYADSVKG | DRAYGDYVGWNGFDY |
| M271-E09 | RASQSISSFLA | DASYRAT | QQRGNWPIT | YYPMI | WISPSGGGTQYADSVKG | DRAYGDYVGWNGFDY |
| M275-G05 | RASQSISSFLA | DASYRAT | QQRGNWPIT | YYPMV | YIWPSGGTYYADSVKG | DRAYGDYVGWNGFDY |
| M277-G02 | RASQSISSFLA | DASYRAT | QQRGNWPIT | YYPMW | SIVPSGGATFYADSVKG | DRAYGDYVGWNGFDY |
| M270-H05 | RASQSISSFLA | DASYRAT | QQRGNWPIT | YYPMW | VIYPSGGATFYADSVKG | DRAYGDYVGWNGFDY |
| M273-A06 | RASQSISSFLA | DASYRAT | QQRGNWPIT | YYPMW | YISSSGGTHYADSVKG | DRAYGDYVGWNGFDY |
| M276-F08 | RASQSISSFLA | DASYRAT | QQRGNWPIT | YYPMW | YIVPSGGATFYADSVKG | DRAYGDYVGWNGFDY |

VL and VH for Fabs affinity matured for binding to hMMP9,
hMMP2, mMMP9, and mMMP2

```
LC for Fab M265-C07
                                                (SEQ ID NO: 6)
QDIQMTQSPA TLSLSPGERA SLSCRASQNV ARFLAWYQQK PGQAPRLLIY SASNRATGVP        60
DRFSGSGSGT DFTLTISSLE PEDFAVYFCQ QRGNWPITFG QGTRLEIK                    108

HC for Fab M265-C07
                                                (SEQ ID NO: 7)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV      120
TVSS                                                                   124

LC for Fab M265-A07
                                                (SEQ ID NO: 8)
QDIQMTQSPA TLSLSPGERA TLSCRASQNV HTYLAWYQQK PGQAPRLLIS EASNRATGVP        60
ARFTGSGSGI DFSLSISSLE PEDFAIYYCQ QRGGWPITFG GGTKVEIK                    108

HC for Fab M265-A07
                                                (SEQ ID NO: 9)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV      120
TVSS                                                                   124

LC for Fab M256-D03
                                                (SEQ ID NO: 10)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108
```

-continued

HC for Fab M256-D03
(SEQ ID NO: 11)
EVQLLESGGG LVQPGGSLRL SCAASGFTFS VYPMIWVRQA PGKGLEWVSY ISPSGGFTGY    60
ADSVKGRFTI SRDNSKNTLY LQMNSLRAED TAVYYCAKDR AYGDYVGWNG FDYWGQGTLV   120
TVSS                                                                124

LC for Fab M256-E10
(SEQ ID NO: 12)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M256-E10
(SEQ ID NO: 13)
EVQLLESGGG LVQPGGSLRL SCAASGFTFS DYPMWWVRQA PGKGLEWVSV IYPSGGATFY    60
ADSVKGRFTI SRDNSKNTLY LQMNSLRAED TAVYYCAKDR AYGDYVGWNG FDYWGQGTLV   120
TVSS                                                                124

LC for Fab M256-E03
(SEQ ID NO: 14)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M256-E03
(SEQ ID NO: 15)
EVQLLESGGG LVQPGGSLRL SCAASGFTFS TYPMIWVRQA PGKGLEWVSY ISPSGGYTGY    60
ADSVKGRFTI SRDNSKNTLY LQMNSLRAED TAVYYCAKDR AYGDYVGWNG FDYWGQGTLV   120
TVSS                                                                124

LC for Fab M256-D11
(SEQ ID NO: 16)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M256-D11
(SEQ ID NO: 17)
EVQLLESGGG LVQPGGSLRL SCAASGFTFS HYDMWWVRQA PGKGLEWVSV IYSSGGPTFY    60
ADSVKGRFTI SRDNSKNTLY LQMNSLRAED TAVYYCAKDR AYGDYVGWNG FDYWGQGTLV   120
TVSS                                                                124

LC for Fab M256-A04
(SEQ ID NO: 18)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M256-A04
(SEQ ID NO: 19)
EVQLLESGGG LVQPGGSLRL SCAASGFTFS HYPMWWVRQA PGKGLEWVSS ISPSGGATYY    60
ADSVKGRFTI SRDNSKNTLY LQMNSLRAED TAVYYCAKDR AYGDYVGWNG FDYWGQGTLV   120
TVSS                                                                124

LC for Fab M256-G09
(SEQ ID NO: 20)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M256-G09
(SEQ ID NO: 21)
EVQLLESGGG LVQPGGSLRL SCAASGFTFS KYPMWWVRQA PGKGLEWVSS IYPSGGATFY    60
ADSVKGRFTI SRDNSKNTLY LQMNSLRAED TAVYYCAKDR AYGDYVGWNG FDYWGQGTLV   120
TVSS                                                                124

LC for Fab M256-A07
(SEQ ID NO: 22)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M256-A07
(SEQ ID NO: 23)
EVQLLESGGG LVQPGGSLRL SCAASGFTFS HYDMLWVRQA PGKGLEWVSY ISSSGGYTGY    60
ADSVKGRFTI SRDNSKNTLY LQMNSLRAED TAVYYCAKDR AYGDYVGWNG FDYWGQGTLV   120
TVSS                                                                124

LC for Fab M256-C09
(SEQ ID NO: 24)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

-continued

HC for Fab M256-C09
(SEQ ID NO: 25)
```
EVQLLESGGG LVQPGGSLRL SCAASGFTFS KYPMWWVRQA PGKGLEWVSY ISSSGGGTFY      60
ADSVKGRFTI SRDNSKNTLY LQMNSLRAED TAVYYCAKDR AYGDYVGWNG FDYWGQGTLV     120
TVSS                                                                 124
```

LC for Fab M256-C07
(SEQ ID NO: 26)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M256-C07
(SEQ ID NO: 27)
```
EVQLLESGGG LVQPGGSLRL SCAASGFTFS LYDMWWVRQA PGKGLEWVSY ISSSGGATFY      60
ADSVKGRFTI SRDNSKNTLY LQMNSLRAED TAVYYCAKDR AYGDYVGWNG FDYWGQGTLV     120
TVSS                                                                 124
```

LC for Fab M256-B03
(SEQ ID NO: 28)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M256-B03
(SEQ ID NO: 29)
```
EVQLLESGGG LVQPGGSLRL SCAASGFTFS RYPMWWVRQA PGKGLEWVSY ISPSGGFTSY      60
ADSVKGRFTI SRDNSKNTLY LQMNSLRAED TAVYYCAKDR AYGDYVGWNG FDYWGQGTLV     120
TVSS                                                                 124
```

LC for Fab M266-E02
(SEQ ID NO: 30)
```
QDIQMTQSPA TLSLSPGETA ILSCRASQSV GRFLAWYQQK PGQAPRLLI GASSRATGIP      60
DRFSGSGSGT DFSLTISRLE PEDFAVYYCQ QRGNWPITFG QGTRLEIK                 108
```

HC for Fab M266-E02
(SEQ ID NO: 31)
```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M266-D03
(SEQ ID NO: 32)
```
QDIQMTQSPA TLSVSPGERA TLSCRASQNI GSDLAWYQHK PGQGPRLLIY GASSRATGIP      60
DRFSGSGSGT DFTLTISSLE PEDFAVYFCQ QRGNWPITFG QGTRLEIK                 108
```

HC for Fab M266-D03
(SEQ ID NO: 33)
```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M263-F05
(SEQ ID NO: 34)
```
QDIQMTQSPG TLSLSPGERA TLSCRASQSV GNFLAWYQQK PGQAPRLLIY GASNRATGIP      60
DRFSGSGSGT DFTLTISRLE PEDFAVYFCQ QRGNWPITFG QGTRLEIK                 108
```

HC for Fab M263-F05
(SEQ ID NO: 35)
```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M264-A09
(SEQ ID NO: 36)
```
QDIQMTQSPS SVSASTGDRV IISCRASQVI FSGLAWYQQK PGKAPKLLIS AASNLQSGVP      60
ARFSGSGSGT YFTLTISSLQ PEDFATYYCQ QAQTFPFTFG PGTKVDVQ                 108
```

HC for Fab M264-A09
(SEQ ID NO: 37)
```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M263-F01
(SEQ ID NO: 38)
```
QDIQMTQSPS SVSASVGDRV TITCRASQNI GRWLAWYQQK PGQAPNLLIY GASSLQTGVP      60
SRFSGSGSGT DFSLTISSLQ PEDFAVYYCQ QRRKWPVTFG GGTKVEIK                 108
```

```
HC for Fab M263-F01
                                                          (SEQ ID NO: 39)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M265-A04
                                                          (SEQ ID NO: 40)
QDIQMTQSPV TLSVSPGERA TLSCRASQNI GSDLAWYQQQ PGQAPRLLIY RASFRATGIP      60
ARFSGSGSGT DFTLTISSLQ SEDFAVYYCQ QRGNWPPTFG GGTKVEIR                 108

HC for Fab M265-A04
                                                          (SEQ ID NO: 41)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M278-C09
                                                          (SEQ ID NO: 42)
QDIQMTQFPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M278-C09
                                                          (SEQ ID NO: 43)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M281-F06
                                                          (SEQ ID NO: 44)
QDIQMTQSPA ALSLSPGERA TLSCRASQSV SSDLAWYQQK PGQAPRLLIY GASTRATGIP      60
ARFSGSRSGT AFTLTISSLE PEDFAVYYCQ QRSNWPVTFG QGTKLEIK                 108

HC for Fab M281-F06
                                                          (SEQ ID NO: 45)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M279-H01
                                                          (SEQ ID NO: 46)
QDIQMTQSPA FLSASLGDRV TITCRATQGI GTFLAWYQQK AGRAPKLLIY GASTLQSGVP      60
SRFSGSGSGT EFTLTISSLQ PEDFATYYCQ QRYTWPITFG QGTRLEIR                 108

HC for Fab M279-H01
                                                          (SEQ ID NO: 47)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M280-G04
                                                          (SEQ ID NO: 48)
QDIQMTQSPA TLPVSPGETV TLSCTASQSV GSHLAWYQQR PNQAPRLLIY DTSSRATGIP      60
ARFSGSGSGT DFTLTITSLE PEDFAVYYCQ QRRSWPLTFG GGTKVEIK                 108

HC for Fab M280-G04
                                                          (SEQ ID NO: 49)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M281-C08
                                                          (SEQ ID NO: 50)
QDIQMTQSPA TLSASPGERA TLSCRASQSV SSDLAWYQQK PGQAPRLLIY GASTRATGIP      60
ARFSGSGSGT EFTLTISSLE PEDFALYYCQ QRAYWPVSFG GGTKVEIK                 108

HC for Fab M281-C08
                                                          (SEQ ID NO: 51)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M287-C10
                                                          (SEQ ID NO: 52)
QDIQMTQSPA TLSFSAGERA TLSCRASQHI YTSLAWYQHK AGQAPRLLIY EASYRATGIP      60
ARFSGSGSGR DFTLTISSLE PEDVAVYYCQ QRGSWPITFG QGTRLEIK                 108
```

```
HC for Fab M287-C10
                                                        (SEQ ID NO: 53)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124

LC for Fab M281-H08
                                                        (SEQ ID NO: 54)
QDIQMTQSPA TLSLSAGERA TLSCRASQSV SSYLAWYQQK PGQAPRLLIY GASTRATGIP      60
ARFSGGGSGT EFTLTISSLE PEDFAVYFCQ QRGFWPITFG QGTRLEIK                  108

HC for Fab M281-H08
                                                        (SEQ ID NO: 55)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124

LC for Fab M292-E02
                                                        (SEQ ID NO: 56)
QDIQMTQSPA TLSLSPGDRA TLSCRASQSV SSYLAWYQQK PGQAPRLLIY GASNRATGIP      60
ARFSGSGSGT DFTLTISSLE PEDYAVYYCQ QRGNWPITFG QGTRLEIK                  108

HC for Fab M292-E02
                                                        (SEQ ID NO: 57)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124

LC for Fab M290-B12
                                                        (SEQ ID NO: 58)
QDIQMTQSPA TLSLSPGDWA TLSCRASQSV SSVAWYQQKP GQAPRLLIYD TSNRATGIPD      60
RFSGSGSGTD FTLTISRLEP EDFAVYYCQQ RTKWPITFGQ GTRLEIK                   107

HC for Fab M290-B12
                                                        (SEQ ID NO: 59)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124

LC for Fab M279-B07
                                                        (SEQ ID NO: 60)
QDIQMTQSPA TLSLSPGEGA TLSCRASESV GMYIAWYQQK PGQAPRLLMY GASNRATGIP      60
ARFRGSGSGT DFTLTISSLE PEDFAVYYCQ QRGNWPITFG QGTRLEIK                  108

HC for Fab M279-B07
                                                        (SEQ ID NO: 61)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124

LC for Fab M296-E03
                                                        (SEQ ID NO: 62)
QDIQMTQSPA TLSLSPGERA TLSCGASQSV SSSYLAWYQQ KPGLAPRLLI YDASSRATGI      60
PDRFSGSGSG TDFTLTISRL EPEDFAVYYC QQYGSSPWTF GPGTTLDFN                 109

HC for Fab M296-E03
                                                        (SEQ ID NO: 63)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124

LC for Fab M282-B10
                                                        (SEQ ID NO: 64)
QDIQMTQSPA TLSLSPGERA TLSCRASPSI SNFLAWYQQR PGQAPRLLIY GASNRATGVP      60
ARFSGSGSGT DFNLTISSVE PEDFAVYYCQ QRRSWPPTFG QGTKLETK                  108

HC for Fab M282-B10
                                                        (SEQ ID NO: 65)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124

LC for Fab M283-D07
                                                        (SEQ ID NO: 66)
QDIQMTQSPA TLSLSPGERA TLSCRASQNI GGYLAWYQQK PGQAPRLLIY GASNRATGVP      60
ARFSGSGSGT DFSLIISSLE TEDFAVYYCQ QRSNWPPTFG GGTKVEIK                  108
```

```
HC for Fab M283-D07
                                                        (SEQ ID NO: 67)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV       120
TVSS                                                                   124

LC for Fab M289-B05
                                                        (SEQ ID NO: 68)
QDIQMTQSPA TLSLSPGERA TLSCRASQNV ANYLDWYQQK PGQAPRLLIY DGSNRATGVP        60
DRFRGSGSET DFTLIISSLE PEDFAVYYCQ QRHSWPPITF GQGTRLQIK                  109

HC for Fab M289-B05
                                                        (SEQ ID NO: 69)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV       120
TVSS                                                                   124

LC for Fab M283-D09
                                                        (SEQ ID NO: 70)
QDIQMTQSPA TLSLSPGERA TLSCRASQNV HTYLAWYQQK PGQAPRLLIS EASNRATGVP        60
ARFTGSGSGT DFTLSISSLE PEDFAIYYCQ QRGGWPITFG GGTKVEIK                   108

HC for Fab M283-D09
                                                        (SEQ ID NO: 71)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV       120
TVSS                                                                   124

LC for Fab M284-B05
                                                        (SEQ ID NO: 72)
QDIQMTQSPA TLSLSPGERA TLSCRASQSI GNHLAWYQQK SGQAPRLLIY DASNRATGIP        60
ARFSGGGSGT DFTLTISSLE PEDFAVYFCQ QRGNWPITFG QGTRLEIK                   108

HC for Fab M284-B05
                                                        (SEQ ID NO: 73)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV       120
TVSS                                                                   124

LC for Fab M293-E07
                                                        (SEQ ID NO: 74)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTKVEIK                   108

HC for Fab M293-E07
                                                        (SEQ ID NO: 75)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV       120
TVSS                                                                   124

LC for Fab M295-G02
                                                        (SEQ ID NO: 76)
QDIQMTQSPA TLSLSPGERA TLSCRASQSI SSFLAWYQQK PGQAPRLLIY GASSRARGTP        60
DRFSGSGSGT DFTLTISSLE PEDYAVYYCQ QRGNWPITFG QGTRLEIK                   108

HC for Fab M295-G02
                                                        (SEQ ID NO: 77)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV       120
TVSS                                                                   124

LC for Fab M293-D07
                                                        (SEQ ID NO: 78)
QDIQMTQSPA TLSLSPGERA TLSCRASQSI SSFLAWYQQK PGQAPRLLIY GASTRATGIP        60
ARFSGSGSGT DFTLTISSLE PEDYAVYYCQ QRGNWPITFG QGTRLEIK                   108

HC for Fab M293-D07
                                                        (SEQ ID NO: 79)
EVQLLESGGG LVQPGGSLRL SCAASGFTFS QYPMWWVRQA PGKGLEWVSY IVPSGGRTYY        60
ADSVKGRFTI SRDNSKNTLY LQMNSLRAED TAVYYCAKDR AYGDYVGWNG FDYWGQGTLV       120
TVSS                                                                   124

LC for Fab M278-B08
                                                        (SEQ ID NO: 80)
QDIQMTQSPA TLSLSPGERA TLSCRASQSI SSHLAWYQQK PGQAPRLVIS GASSRATGIP        60
DRFSGSGSGT DFTLTISRLE PEDYAVYYCQ QRGNWPITFG QGTRLEIK                   108
```

-continued

HC for Fab M278-B08

(SEQ ID NO: 81)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M283-D02

(SEQ ID NO: 82)
QDIQMTQSPA TLSLSPGERA TLSCRASQSI STSLAWYQQK PGQAPRLLIY DASNRAAVIP    60
ARFSGSGSGT DFTLTISNLE PEDSAVYYCQ QRGAWPLTFG GGTKVEIK                108

HC for Fab M283-D02

(SEQ ID NO: 83)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M281-A02

(SEQ ID NO: 84)
QDIQMTQSPA TLSLSPGERA TLSCRASQSL GRSDLAWYQQ KPGQAPRLLI FGVSNRVTGT    60
PDRFSGSGSG TDFSLTISSL EPEDFAVYYC QQRSNWPPTF GGGTKLEIK               109

HC for Fab M281-A02

(SEQ ID NO: 85)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M280-H04

(SEQ ID NO: 86)
QDIQMTQSPA TLSLSPGERA TLSCRASQSL GRSDLAWYQQ KPGQAPRLLI FGVSNRVTGT    60
PDRFSGSGSG TDFTLTIGSL EPEDFAVYYC QQRSTWPITF GQGTRLEIK               109

HC for Fab M280-H04

(SEQ ID NO: 87)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M285-D05

(SEQ ID NO: 88)
QDIQMTQSPA TLSLSPGERA TLSCRASQSL GSFLAWYQQK PGQAPRLLIY GASYRATGIP    60
ARFSGSGSGT DFTLTISSLE PEDYAVYYCQ QRGNWPITFG QGTRLEIK                108

HC for Fab M285-D05

(SEQ ID NO: 89)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M285-C03

(SEQ ID NO: 90)
QDIQMTQSPA TLSLSPGERA TLSCRASQSV DSYLAWYQQK PGQAPRLLIY DASNRATGIP    60
ARFSGSGSGT DFTLTISNLE PEDFAVYYCQ HRRSWPLTFG GGTKVEIK                108

HC for Fab M285-C03

(SEQ ID NO: 91)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M284-A01

(SEQ ID NO: 92)
QDIQMTQSPA TLSLSPGERA TLSCRASQSV DSYLAWYQQK PGQAPRLLIY GASNRATGIP    60
ARFSGSGSGT DFTLTIASLE PEDFAVYYCQ QRRKWPVTFG GGTKVEIK                108

HC for Fab M284-A01

(SEQ ID NO: 93)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M279-F11

(SEQ ID NO: 94)
QDIQMTQSPA TLSLSPGERA TLSCRASQSV GGDIAWYQQK PGQAPRLLMY GASNRATGIP    60
ARFSGSGSGT DFTLTISSLE PEDFAVYYCQ QRSYWPVTFG GGTRVEIK                108

HC for Fab M279-F11

(SEQ ID NO: 95)

```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M279-B09

(SEQ ID NO: 96)

```
QDIQMTQSPA TLSLSPGERA TLSCRASQSV GRDLAWYQQK PGQAPRLLIY GATTRATGIP      60
ARFSGSGSGT DFTLTISSLE PEDFAVYFCQ QRGNWPITFG QGTRLEIK                 108
```

HC for Fab M279-B09

(SEQ ID NO: 97)

```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M281-F02

(SEQ ID NO: 98)

```
QDIQMTQSPA TLSLSPGERA TLSCRASQSV GSDLAWYQQK HGQAPRLLMY GASTRATGIP      60
ARFSGSGSGT DFTLTISSLE PEDFAVYFCQ QRGNWPITFG QGTRLEIK                 108
```

HC for Fab M281-F02

(SEQ ID NO: 99)

```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M297-F05

(SEQ ID NO: 100)

```
QDIQMTQSPA TLSLSPGERA TLSCRASQSV GSFLAWYQQK PGQAPRLLIY GASNRATGIP      60
PRFSGSGSGT DFTLTISSLE PEDSAAYYCQ QRGNWPITFG QGTRLEIK                 108
```

HC for Fab M297-F05

(SEQ ID NO: 101)

```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M285-C08

(SEQ ID NO: 102)

```
QDIQMTQSPA TLSLSPGERA TLSCRASQSV GSQLAWYQQK PGQAPRLLIY DASYRATGIP      60
VRFSGSGSGT DFTLTISSLE PEDYAVYYCQ QRGNWPITFG QGTRLEIK                 108
```

HC for Fab M285-C08

(SEQ ID NO: 103)

```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M292-H03

(SEQ ID NO: 104)

```
QDIQMTQSPA TLSLSPGERA TLSCRASQSV GTHLAWYQQK PGQAPRLLIY GASTRATGIP      60
ARFSGSGSGT EFTLTISSLQ SEDFAIYHCQ QRRSWPITFG QGTRLEIK                 108
```

HC for Fab M292-H03

(SEQ ID NO: 105)

```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M288-E08

(SEQ ID NO: 106)

```
QDIQMTQSPA TLSLSPGERA TLSCRASQSV NHFLAWYQQK PGQAPRLLIY GASNRATGVP      60
ARFNGTGSGT DFTLTISSLE PEDFAVYYCQ QRGSWPITFG QGTRLEIK                 108
```

HC for Fab M288-E08

(SEQ ID NO: 107)

```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M283-H10

(SEQ ID NO: 108)

```
QDIQMTQSPA TLSLSPGERA TLSCRASQSV NSFLAWYQQK AGQAPRLLIY DASNRATGIP      60
ARFSGSGSGT DFTLTISSLE PEDFAVYYCQ QRSNWPITFG QGTRLEIR                 108
```

-continued

HC for Fab M283-H10

(SEQ ID NO: 109)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M280-G06

(SEQ ID NO: 110)
QDIQMTQSPA TLSLSPGERA TLSCRASQSV NSYLAWYQQK PGQAPRLLIY DASNRATGIP     60
ARFSGSGSGT DFTLTISSLE PEDFAVYYCQ QRGYWPPSFG GGTKVEIL                 108

HC for Fab M280-G06

(SEQ ID NO: 111)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M293-E02

(SEQ ID NO: 112)
QDIQMTQSPA TLSLSPGERA TLSCRASQSV SNFLAWYQQK PGQAPRLLIY GASSRATGIP     60
DRFSGSGSGT DFTLTISSLE PEDFAVYYCQ QRGNWPITFG QGTRLEIK                 108

HC for Fab M293-E02

(SEQ ID NO: 113)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M296-D03

(SEQ ID NO: 114)
QDIQMTQSPA TLSLSPGERA TLSCRASQSV SNYLAWYQQK RGQAPRLLIY GASTRATGIP     60
ARFSGSGSGT EFTLTISSLQ SEDFAVYYCQ QRGNWPITFG QGTRLEIK                 108

HC for Fab M296-D03

(SEQ ID NO: 115)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M296-E02

(SEQ ID NO: 116)
QDIQMTQSPA TLSLSPGERA TLSCRASQSV SRYLAWYQQK PGQAPRLLIY DASSRATGVP     60
ARFSGGGSGT DFTLTISSLE PEDFAVYYCH QRSSWPITFG QGTRLEIK                 108

HC for Fab M296-E02

(SEQ ID NO: 117)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M281-H07

(SEQ ID NO: 118)
QDIQMTQSPA TLSLSPGERA TLSCRASQSV SRYLAWYQQR PGQAPRLLIY DASNRATGIP     60
ARFSGSGSGT DFTLTISSLE PEDFAVYYCQ QRINWPLTFG GGTKVEIK                 108

HC for Fab M281-H07

(SEQ ID NO: 119)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M283-C02

(SEQ ID NO: 120)
QDIQMTQSPA TLSLSPGERA TLSCRASQSV SSFLAWYQQK PGQAPRLLIY HASNRATGIP     60
ARFRGSGSGT DFTLTISSLE PEDFAVYYCQ QRGNWPITFG QGTRLEIK                 108

HC for Fab M283-C02

(SEQ ID NO: 121)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M282-E10

(SEQ ID NO: 122)
QDIQMTQSPA TLSLSPGERA TLSCRASQSV SSFLAWYQQK PGRAPRLVIY DASNRASGIP     60
ARFSGSGSGA DFTLTITSLE PEDFAVYYCQ QRANWPLTFG GGTRVEIK                 108

```
HC for Fab M282-E10
                                                       (SEQ ID NO: 123)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M293-E12
                                                       (SEQ ID NO: 124)
QDIQMTQSPA TLSLSPGERA TLSCRASQSV SSHLAWYQQK PGQAPRLLIY GASSRATGIP     60
DRFSGSGSGT DFTLTISRLE PEDFAVYYCQ QRGNWPITFG QGTRLEIK                 108

HC for Fab M293-E12
                                                       (SEQ ID NO: 125)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M278-G02
                                                       (SEQ ID NO: 126)
QDIQMTQSPA TLSLSPGERA TLSCRASQSV SSYLAWYKQK PGQAPRLLIY DASNRATGIP     60
ARFSGSGSGT DFTLTISSLE PEDFAVYFCQ QRGNWPITFG QGTRLEIK                 108

HC for Fab M278-G02
                                                       (SEQ ID NO: 127)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M284-D11
                                                       (SEQ ID NO: 128)
QDIQMTQSPA TLSLSPGERA TLSCRASQSV SSYLAWYKQK PGQAPRLLIY GASNRATGIP     60
ARFSGSGSGT DFTLTISSLE PEDFAVYFCQ QRGNWPITFG QGTRLEIK                 108

HC for Fab M284-D11
                                                       (SEQ ID NO: 129)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M278-B03
                                                       (SEQ ID NO: 130)
QDIQMTQSPA TLSLSPGERA TLSCRASQSV SSYLAWYQQK PGHAPRLLIY GASHRATGIA     60
DRFSGSGSGT DFTLTISSLE PEDFAVYYCQ QRSNWPITFG QGTRLEIK                 108

HC for Fab M278-B03
                                                       (SEQ ID NO: 131)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M280-C06
                                                       (SEQ ID NO: 132)
QDIQMTQSPA TLSLSPGERA TLSCRASQSV SSYLAWYQQK PGQAPRLLIY DASNRATGIP     60
ARFRGSGSGT DFTLTISSLE PEDFAVYYCQ QRGNWPITFG QGTRLEIK                 108

HC for Fab M280-C06
                                                       (SEQ ID NO: 133)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M283-G06
                                                       (SEQ ID NO: 134)
QDIQMTQSPA TLSLSPGERA TLSCRASQSV SSYLAWYQQK PGQAPRLLIY DASNRATGIP     60
ARFSGSGSGT DFTLTISSLE PADFAVYYCQ QRSNWPTTFG QGTRLEIK                 108

HC for Fab M283-G06
                                                       (SEQ ID NO: 135)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M279-D12
                                                       (SEQ ID NO: 136)
QDIQMTQSPA TLSLSPGERA TLSCRASQSV SSYLAWYQQK PGQAPRLLIY DASNRATGIP     60
ARFSGSGSGT DFTLTISSLE PEDFAVYYCQ QRGNWPITFG QGTRLEIK                 108
```

```
HC for Fab M279-D12
                                                   (SEQ ID NO: 137)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M279-A02
                                                   (SEQ ID NO: 138)
QDIQMTQSPA TLSLSPGERA TLSCRASQSV SSYLAWYQQK PGQAPRLLIY GASNRATGIP    60
ARFSGSGSGT DFTLTISSLE PEDFVVYFCQ QRSNWPITFG QGTRLEIK                108

HC for Fab M279-A02
                                                   (SEQ ID NO: 139)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M287-F03
                                                   (SEQ ID NO: 140)
QDIQMTQSPA TLSLSPGERA TLSCRASQSV SSYLAWYQQK PGQAPRLLIY GASSRATGIP    60
DRFSGSGSGT DFTLTISSLE PEDFAVYYCQ QRSNWPVTFG PGTTVDIK                108

HC for Fab M287-F03
                                                   (SEQ ID NO: 141)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M284-F02
                                                   (SEQ ID NO: 142)
QDIQMTQSPA TLSLSPGERA TLSCRASQSV SSYLAWYQQK PGQAPRLLIY GASTRATGIP    60
ARFSGSGSGT DFTLTISSLE PEDFAVYYCQ QRGNWPITFG QGTRLEIK                108

HC for Fab M284-F02
                                                   (SEQ ID NO: 143)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M282-H04
                                                   (SEQ ID NO: 144)
QDIQMTQSPA TLSLSPGERA TLSCRASQSV SSYLAWYQQK PGQAPRLLIY GASNRATGIS    60
DRFSGSGSGT DFTLTISRLE PEDFATYYCQ QRGNWPPTFG GGTKVEIR                108

HC for Fab M282-H04
                                                   (SEQ ID NO: 145)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M278-A08
                                                   (SEQ ID NO: 146)
QDIQMTQSPA TLSLSPGERA TLSCRASQSV SSYLAWYQQR LGQSPRLLIY GASNRATGIP    60
DRFSGSGSGT DFTLTISSLE PEDFAVYYCE QRRSWPLTFG GGTKVEIK                108

HC for Fab M278-A08
                                                   (SEQ ID NO: 147)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M293-C05
                                                   (SEQ ID NO: 148)
QDIQMTQSPA TLSLSPGERA TLSCRASRSV GTHLAWYQQK PGQPPRLLIY DASVRAAGVP    60
ARFSGSGSGT DFTLSISSLE SDDFAVYYCQ QRGGWPITFG GGTKVEIK                108

HC for Fab M293-C05
                                                   (SEQ ID NO: 149)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M280-E08
                                                   (SEQ ID NO: 150)
QDIQMTQSPA TLSLSPGERA TLSCRASRSV GTHLAWYQQK PGQPPRLLIY DASVRAAGVP    60
ARFSGSGSGT DFTLTISSLE PEDFAVYFCQ QRGNWPITFG QGTRLEIK                108
```

-continued

HC for Fab M280-E08

(SEQ ID NO: 151)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M287-B07

(SEQ ID NO: 152)
QDIQMTQSPA TLSLSPGERA TLSCRTSQSV SRYLAWYQQK PGQAPRLLIY GTSNRATGIP    60
ARFSGSGSGT DFTLTIDSLE PEDFAIYYCQ QRYNWPITFG QGTRLEIK               108

HC for Fab M287-B07

(SEQ ID NO: 153)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M280-H10

(SEQ ID NO: 154)
QDIQMTQSPA TLSLSPGERA TLSCRTSQSV SRYLAWYQQK PGQAPRLLIY GTSNRATGIP    60
ARFSGSGSGT DFTLTISSLE PEDFAVYYCQ QRYNWPITFG QGTRLEIK               108

HC for Fab M280-H10

(SEQ ID NO: 155)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M286-E07

(SEQ ID NO: 156)
QDIQMTQSPA TLSLSPGERA TLTCRASQSL SRSDLAWYQQ PRGQAPRLLI FGASNRATDT    60
PDRFSGSGSG TDFTLTITRL EPEDFAVYYC QQRSNWPPTF GQGTKLEIK              109

HC for Fab M286-E07

(SEQ ID NO: 157)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M280-E12

(SEQ ID NO: 158)
QDIQMTQSPA TLSLSPGESA TLSCRASQSV SSYLAWYQQK PGQAPRLLIY GASNRATGIP    60
ARFSGSGSGT DFTLTISSLE PEDFVVYFCQ QRSNWPITFG QGTRLEIK               108

HC for Fab M280-E12

(SEQ ID NO: 159)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M281-A05

(SEQ ID NO: 160)
QDIQMTQSPA TLSLSPGETA ILSCRASQSV GRFLAWYQQK PGQAPRLLIY GASSRATGIP    60
DRFSGSGSGT EFTLTISSLQ SEDFAVYYCQ QRGNWPITFG QGTRLEIK               108

HC for Fab M281-A05

(SEQ ID NO: 161)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M283-C11

(SEQ ID NO: 162)
QDIQMTQSPA TLSLSPGETA TLSCRASQPV GSYLAWYQQK PGQAPRLLIY GASNRATGIP    60
ARFSGSGSGT DFTLTISSLE PEDFAVYYCQ QRGNWPLTFG GGTKVEIK               108

HC for Fab M283-C11

(SEQ ID NO: 163)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M279-F07

(SEQ ID NO: 164)
QDIQMTQSPA TLSLSPGETA TLSCRASQSV GYYLAWYQQR PGQAPRLLIF GASRRATGIP    60
DRFSGSGSGT DFTLTISRLE PEDFAVYYCQ QRSNWPITFG QGTRLEIK               108

-continued

HC for Fab M279-F07

(SEQ ID NO: 165)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M284-H03

(SEQ ID NO: 166)
QDIQMTQSPA TLSVSPGDRA TLSCRTSQRV DSNLAWYQQK PGQPPRLLIY GASTRATGVP    60
TRFRGSGSGT DFTLTITSLE PEDFAVYYCQ QRRKWPVTFG GGTKVEIK                108

HC for Fab M284-H03

(SEQ ID NO: 167)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M295-G08

(SEQ ID NO: 168)
QDIQMTQSPA TLSVSPGDTA TLSCRASQSV GSDLAWYQQK PGQAPRLLIY GASSRATGIP    60
DRFSGSGSGT DFTLTISRLE PEDFAVYYCQ QRGNWPITFG QGTRLEIK                108

HC for Fab M295-G08

(SEQ ID NO: 169)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M287-E01

(SEQ ID NO: 170)
QDIQMTQSPA TLSVSPGEIA TLSCRASQNI GSNLAWYQQK PGQAPRLLIY GASTRAPGIP    60
ARFSGSGSGT EFTLTIRSLQ SEDFAVYYCQ QRRKWPVTFG GGTKVEIK                108

HC for Fab M287-E01

(SEQ ID NO: 171)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M286-B09

(SEQ ID NO: 172)
QDIQMTQSPA TLSVSPGEKV TLSCRASQNI ITNLAWYQQK PGQAPRLLIY GASTRATGIP    60
ARFSGSGSGT DFTLTISSLE PEDFAVYYCQ QRSNWPITFG PGTKVDIK                108

HC for Fab M286-B09

(SEQ ID NO: 173)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M294-A12

(SEQ ID NO: 174)
QDIQMTQSPA TLSVSPGERA TLSCRAHSV GSDLAWYQQK PGQAPRLLIS GASTRTAGIP     60
ARFSGSGSGT DFTLTISNLE PEDFAVYYCQ QRGNWPPTFG GGTKVEIR                108

HC for Fab M294-A12

(SEQ ID NO: 175)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M287-C12

(SEQ ID NO: 176)
QDIQMTQSPA TLSVSPGERA TLSCRASQGV GSDLAWYLQK PGQAPRLLIY GASSRATGIP    60
DRFSGSGSGT DFTLTISRLE PEDFAVYYCQ QRRSWPPTFG QGTKVEIK                108

HC for Fab M287-C12

(SEQ ID NO: 177)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M290-C09

(SEQ ID NO: 178)
QDIQMTQSPA TLSVSPGERA TLSCRASQNV NRDLAWYQQK PGQAPRLLIF GASTRATGIP    60
ARFSGSGSGT DFTLTISSLE PEDFAVYFCQ QRGNWPITFG QGTRLEIK                108

```
HC for Fab M290-C09
                                                   (SEQ ID NO: 179)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M294-C10
                                                   (SEQ ID NO: 180)
QDIQMTQSPA TLSVSPGERA TLSCRASQSI NSDLAWYQQK PGQAPRLLIY HTSYRAPGIP     60
ARFRGSGSGT DFTLTISSLE PEDFALYFCQ QRSDWPVTFG PGTKVDVK                 108

HC for Fab M294-C10
                                                   (SEQ ID NO: 181)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M278-D06
                                                   (SEQ ID NO: 182)
QDIQMTQSPA TLSVSPGERA TLSCRASQSI SSDLAWYQQR PGQAPRLLIY GASSRATGVP     60
ARFSGSGSGT EFALTISSLE PEDFAVYYCQ QRSYWPVTFG GGTRVEIK                 108

HC for Fab M278-D06
                                                   (SEQ ID NO: 183)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M290-E01
                                                   (SEQ ID NO: 184)
QDIQMTQSPA TLSVSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M290-E01
                                                   (SEQ ID NO: 185)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M293-E09
                                                   (SEQ ID NO: 186)
QDIQMTQSPA TLSVSPGERA TLSCRASQSV GADLAWYQQK PGQAPRLLIY HASTRATGVP     60
ARFSGSGSGS EFTLAISSLQ SEDFAVYFCQ QRGNWPPTFG GGTKVDIK                 108

HC for Fab M293-E09
                                                   (SEQ ID NO: 187)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M288-G11
                                                   (SEQ ID NO: 188)
QDIQMTQSPA TLSVSPGERA TLSCRASQSV GSDLAWYQQK HGQAPRLLMY GASHRATGIP     60
ARFSGSGSGT DFTLTISSLE PEDFAVYYCQ QRYNWPITFG GGTKVEIK                 108

HC for Fab M288-G11
                                                   (SEQ ID NO: 189)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M284-B09
                                                   (SEQ ID NO: 190)
QDIQMTQSPA TLSVSPGERA TLSCRASQSV GSDLAWYQQK HGQAPRLLMY GASTRATGIP     60
DRFSGSGSGT DFTLTISRLE PEDFAVYYCQ QRGNWPPTFG GGTKVEIR                 108

HC for Fab M284-B09
                                                   (SEQ ID NO: 191)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV    120
TVSS                                                                 124

LC for Fab M297-A11
                                                   (SEQ ID NO: 192)
QDIQMTQSPA TLSVSPGERA TLSCRASQSV GSNLAWYQQK PGQAPRLLIY GASIRATGIP     60
ARFSGSGSGT DFTLTISSLE PEDFAVYFCQ QRGNWPITFG QGTRLEIK                 108
```

```
HC for Fab M297-A11
                                                             (SEQ ID NO: 193)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M294-F06
                                                             (SEQ ID NO: 194)
QDIQMTQSPA TLSVSPGERA TLSCRASQSV GSNLAWYQQK PGQAPRLLIY GASTRATGIP     60
ARFSGSGSGT EFTLTISSLQ SEDFAMYYCQ QRAYWPVSFG GGTKVEIK                 108

HC for Fab M294-F06
                                                             (SEQ ID NO: 195)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M295-E02
                                                             (SEQ ID NO: 196)
QDIQMTQSPA TLSVSPGERA TLSCRASQSV GSNLAWYQQK PGQAPRLLIY GASTRATGIP     60
ARFSGSGSGT EFTLTISSLQ SEDFAVYYCQ QRGNWPITFG QGTRLEIK                 108

HC for Fab M295-E02
                                                             (SEQ ID NO: 197)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M289-H10
                                                             (SEQ ID NO: 198)
QDIQMTQSPA TLSVSPGERA TLSCRASQSV GSNLAWYQQK PGQAPRLLIY GASTRATGIP     60
ARFSGSGSGT EFTLTVSSLQ SEDFAVYYCQ QRRNWPVTFG PGTKLDFK                 108

HC for Fab M289-H10
                                                             (SEQ ID NO: 199)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M283-E03
                                                             (SEQ ID NO: 200)
QDIQMTQSPA TLSVSPGERA TLSCRASQSV GSQLAWYQQK PGQAPRLVVY DASTRATGIP     60
ARFSGSGSGT DFTLTISSLE PEDYAVYYCQ QRGNWPITFG QGTRLEIK                 108

HC for Fab M283-E03
                                                             (SEQ ID NO: 201)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M279-E12
                                                             (SEQ ID NO: 202)
QDIQMTQSPA TLSVSPGERA TLSCRASQSV NSDLAWYQQK PGQAPRLLIY GASTRATGIP     60
ARFSGSGSGT DFTLTISSLE PEDYAVYYCQ QRGNWPITFG QGTRLEIK                 108

HC for Fab M279-E12
                                                             (SEQ ID NO: 203)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M290-A11
                                                             (SEQ ID NO: 204)
QDIQMTQSPA TLSVSPGERA TLSCRASQSV NTDLAWYQQK PGQAPRLLIY GASTRATGIP     60
ARFSGSGSGT EFTLTISSLQ SEDFAVYYCQ QRRNWPVTFG QGTRLEII                 108

HC for Fab M290-A11
                                                             (SEQ ID NO: 205)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                124

LC for Fab M284-G09
                                                             (SEQ ID NO: 206)
QDIQMTQSPA TLSVSPGERA TLSCRASQSV SSDLAWYQQI PGQAPRLLIY GASTRATGIP     60
VRFSGSGSGT NFTLTISSLE PEDFAVYYCQ QRRKWPVTFG GGTKVEIK                 108
```

```
HC for Fab M284-G09
                                                      (SEQ ID NO: 207)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M281-C06
                                                      (SEQ ID NO: 208)
QDIQMTQSPA TLSVSPGERA TLSCRASQSV SSDLAWYQQK PGQAPRLLIY AASTRATGIP      60
ARFSGSGSGT EFTLTISSLQ SEDFAVYYCQ QRSNWPVTFG QGTKLEIK                  108

HC for Fab M281-C06
                                                      (SEQ ID NO: 209)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M279-C05
                                                      (SEQ ID NO: 210)
QDIQMTQSPA TLSVSPGERA TLSCRASQSV SSDLAWYQQK PGQAPRLLIY HTSYRAPGIP      60
ARFRGSGSGT DFTLTISSLE PEDFALYFCQ QRSDWPVTFG PGTKVDVK                  108

HC for Fab M279-C05
                                                      (SEQ ID NO: 211)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M293-F04
                                                      (SEQ ID NO: 212)
QDIQMTQSPA TLSVSPGERA TLSCRASQSV SSDLAWYQQK PGQAPRLLIY RASIRATGIP      60
ARFSGSGSGT DFTLTISSLE PEDFAVYFCQ QRGFWPITFG QGTRLEIK                  108

HC for Fab M293-F04
                                                      (SEQ ID NO: 213)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M296-G08
                                                      (SEQ ID NO: 214)
QDIQMTQSPA TLSVSPGERA TLSCRASQSV SSDLAWYQQK PGQAPRLLIY RASIRATGIP      60
ARFSGSGSGT EFTLTISSLQ SEDFAVYYCQ QRSAWPVTFG GGSKVDIKRT                110

HC for Fab M296-G08
                                                      (SEQ ID NO: 215)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M281-C10
                                                      (SEQ ID NO: 216)
QDIQMTQSPA TLSVSPGERA TLSCRASQSV SSDLAWYQQR PGQAPRLLIF GASTRATGIP      60
ARFSGSGSGT DFSLTISSLE PEDFAVYYCQ QRSNWPPTFG GGTKVEIK                  108

HC for Fab M281-C10
                                                      (SEQ ID NO: 217)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M281-H10
                                                      (SEQ ID NO: 218)
QDIQMTQSPA TLSVSPGERA TLSCRASQSV SSNLAWYQQK PGQAPRLLIY GASTRATGIP      60
ARFSGSGSGT EFTLTISSLE PEDFAVYYCQ QCYNWPPTFG QGTKVEIK                  108

HC for Fab M281-H10
                                                      (SEQ ID NO: 219)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M282-E04
                                                      (SEQ ID NO: 220)
QDIQMTQSPA TLSVSPGERA TLSCRASQSV SSNLAWYQQK PGQARLLIY GASTRATGIP       60
ARFSGSGSGT EFTLTISSLQ SEDFAVYYCQ QRGNWPITFG QGTRLEIK                  108
```

```
HC for Fab M282-E04
                                                         (SEQ ID NO: 221)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M279-B02
                                                         (SEQ ID NO: 222)
QDIQMTQSPA TLSVSPGERA TLSCRASQSV SSNLAWYQQK PGQAPRLLIY GASTRATGIP      60
ARFSGSGSGT EFTLTISSLQ SEDFAVYYCQ QRRNWPVTFG QGTRLEII                  108

HC for Fab M279-B02
                                                         (SEQ ID NO: 223)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M286-D09
                                                         (SEQ ID NO: 224)
QDIQMTQSPA TLSVSPGERA TLSCRASQSV SSNLAWYQQK PGQAPRLLIY HASTRATGVP      60
ARFSGSGSGS EFTLAISSLE PEDFAVYFCQ QRGFWPITFG QGTRLEIK                  108

HC for Fab M286-D09
                                                         (SEQ ID NO: 225)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M279-F02
                                                         (SEQ ID NO: 226)
QDIQMTQSPA TLSVSPGERA TLSCRASQSV SSYLAWYQQR PGQAPRLLIF GASNTATGIP      60
ARFSGSGSGT DFTLTISSLE PEDFGVYYCQ QRRNWPPTFG QGTKLEIK                  108

HC for Fab M279-F02
                                                         (SEQ ID NO: 227)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M292-E07
                                                         (SEQ ID NO: 228)
QDIQMTQSPA TLSVSPGERA TLSCRASQSV WSNLAWYQQK PGQAPRLLIY DASYRATGIP      60
ARFSGSGSGT DFTLTISSLE PEDYAVYYCQ QRGNWPITFG QGTRLEIK                  108

HC for Fab M292-E07
                                                         (SEQ ID NO: 229)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M284-B10
                                                         (SEQ ID NO: 230)
QDIQMTQSPA TLSVSPGERA TLSCRASQTV GTFLAWYQHR PGQAPRLLIY GASTRATGIP      60
ARFSGSGSGT EFTLTISSLE PEDFAVYYCQ QRSNWPPTFG QGTKVEIK                  108

HC for Fab M284-B10
                                                         (SEQ ID NO: 231)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M297-B06
                                                         (SEQ ID NO: 232)
QDIQMTQSPA TLSVSPGERA TVSCRASESV NSDLAWYQQK PGQAPRLLIY GASTRATGIP      60
ARFSGSGSGT EFTLTISSME SEDFAVYYCQ QRGSWPITFG QGTRLEIK                  108

HC for Fab M297-B06
                                                         (SEQ ID NO: 233)
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                  124

LC for Fab M280-B02
                                                         (SEQ ID NO: 234)
QDIQMTQSPA TLSVSPGERV ILSCRASQNI NSDLAWYKQI PGQAPRLLIY GASTRATGVP      60
ARISGSGSGT EFTLTISSLQ SEDFAVYYCQ QRGGWPITFG GGTKVEIK                  108
```

HC for Fab M280-B02
(SEQ ID NO: 235)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M279-A03
(SEQ ID NO: 236)
QDIQMTQSPA TLSVSPGERV TLSCKASHSI SRNLAWYQQK PGQAPRLLIF GASTRATGIP     60
ARFSGSGSGT EFTLTISSLE AEDFAVYYCQ QRRNWPVTFG PGTKLDFK                 108

HC for Fab M279-A03
(SEQ ID NO: 237)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M280-C09
(SEQ ID NO: 238)
QDIQMTQSPA TLSVSPGERV TLSCRASQTI FGDLAWFQQK PGQSPRLLIY GASTRATDIP     60
ARFSGSGSGT EFTLTISSLE PEDFAVYYCQ QRSNWPPTFG GGTKVEIK                 108

HC for Fab M280-C09
(SEQ ID NO: 239)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M278-H03
(SEQ ID NO: 240)
QDIQMTQSPA TLSVSPGERV TLSCRASRSV SNNVAWYQQK PGQAPRLLIS EASNRATGVP     60
ARFTGSGSGI DFSLSISSLE PEDFAIYYCQ QRGGWPITFG GGTKVEIK                 108

HC for Fab M278-H03
(SEQ ID NO: 241)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M284-G06
(SEQ ID NO: 242)
QDIQMTQSPA TVSLSPGERV TLSCRASQSV SNYLAWYQQK PGQAPRLLIY GASNRATGIP     60
ARFSGSGSGT DFTLTISSLE PEDFAVYYCQ QRRSWPPTFG QGTKVEIK                 108

HC for Fab M284-G06
(SEQ ID NO: 243)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M284-G01
(SEQ ID NO: 244)
QDIQMTQSPA TVSVSPGERA TLSCRASQSV GSDLAWYQQK PGQAPRLLIY GASTRATGIP     60
ARFSGSGSGT EFTLTITSLQ SEDFAVYYCQ QRSNWPVTFG GGTKVEIK                 108

HC for Fab M284-G01
(SEQ ID NO: 245)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M278-H12
(SEQ ID NO: 246)
QDIQMTQSPD ILSLSPGERA TISCRASQSV NSHVAWYQQK PGQPPRLLIY EASDRAAGVP     60
ARFRGSGSGT LFSLTISSLQ PEDFVVYYCQ QRMYWPPTFG EGTKLERR                 108

HC for Fab M278-H12
(SEQ ID NO: 247)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M282-C08
(SEQ ID NO: 248)
QDIQMTQSPD TLSLSPGERA TLTCRASQSL SRSDLAWYQQ RPGQAPRLLI FGASNRATDT     60
PDRFSGSGSG TDFTLTITRL EPEDFAVYYC QQRSNWPPTF GQGTKVEIT                109

-continued

HC for Fab M282-C08

(SEQ ID NO: 249)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M283-C10

(SEQ ID NO: 250)
QDIQMTQSPD TLSVSPGERA TLSCRASQNI GSNLAWYQHK SGQAPRLLIY GATTRATGIP    60
ARFSGSGSGT EFTLTISSLQ SEDFAVYFCQ QRGNWPITFG QGTRLEIK               108

HC for Fab M283-C10

(SEQ ID NO: 251)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M279-H07

(SEQ ID NO: 252)
QDIQMTQSPD TVSVSPGEGA TLSCRASQGI NNNLAWYQQK PGQAPRLLIY DASNRATGIP    60
ARFSGSGSGT DFTLTISSLE PEDFAVYFCQ QRGNWPITFG QGTRLEIK               108

HC for Fab M279-H07

(SEQ ID NO: 253)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M280-F10

(SEQ ID NO: 254)
QDIQMTQSPG TLSFSPGERA SLSCRASQSV SSDLAWYQQK PGQAPRLLIY GASNRATGIP    60
VRFSGSGSGT DFTLTISRLE PEDFAVYYCQ QRSKWPITFG QGTRLEIK               108

HC for Fab M280-F10

(SEQ ID NO: 255)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M281-F01

(SEQ ID NO: 256)
QDIQMTQSPG TLSLSPGDRA TLSCRASQSV GSDLAWYQQK PGQAPRLLIY GASNRATGIP    60
VRFSGSGSGT DFTLTISSLE PEDFAVYYCQ QRSNWPITFG QGTRLEIK               108

HC for Fab M281-F01

(SEQ ID NO: 257)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M284-F10

(SEQ ID NO: 258)
QDIQMTQSPG TLSLSPGDRA TLSCRASQSV GSFLAWYQQR PGQAPRLLIY GASNRAPGIP    60
ARFSGSGSGT DFTLTISSLE PEDFAVYFCQ QRHNWPITFG QGTRLEIK               108

HC for Fab M284-F10

(SEQ ID NO: 259)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M286-E06

(SEQ ID NO: 260)
QDIQMTQSPG TLSLSPGEGA TLSCRASQSV SNYLAWYQQK PGQAPRLLIY GVSNRATGIP    60
DRFSGSGSGT DFTLTISRLE PEDFAVYYCQ QRGNWPPTFG GGTKVEIR               108

HC for Fab M286-E06

(SEQ ID NO: 261)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124

LC for Fab M294-G09

(SEQ ID NO: 262)
QDIQMTQSPG TLSLSPGERA TLSCRASQNL GRSDLAWYQQ KPGQAPKFLI FGVSNRATGT    60
PDRFSGSGSG TDFTLTISSL EPEDFAVYYC QQRSNWPPTF GGGTKVEIK              109

```
HC for Fab M294-G09
                                                     (SEQ ID NO: 263)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M285-H12
                                                     (SEQ ID NO: 264)
QDIQMTQSPG TLSLSPGERA TLSCRASQNV HTYLAWYQQK PGQAPRLLIS EASNRATGVP    60
ARFTGSGSGI DFSLSISSLE PEDFAIYYCQ QRGGWPITFG GGTKVEIK               108

HC for Fab M285-H12
                                                     (SEQ ID NO: 265)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M278-D08
                                                     (SEQ ID NO: 266)
QDIQMTQSPG TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M278-D08
                                                     (SEQ ID NO: 267)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M281-E06
                                                     (SEQ ID NO: 268)
QDIQMTQSPG TLSLSPGERA TLSCRASQSL GRGDLAWYQQ NPGQPPRLLI YGASSRATGI    60
PDRFSGSGSG TDFTLTISRL EPEDFAVYYC QQRSNWPPTF GGGTKVEIK               109

HC for Fab M281-E06
                                                     (SEQ ID NO: 269)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M284-A06
                                                     (SEQ ID NO: 270)
QDIQMTQSPG TLSLSPGERA TLSCRASQSL GRSDLAWYQQ KPGQAPRLLI FGVSNRVTGT    60
PDRFSGSGSG TDFTLTIGSL EPEDFAVYYC QQRSNWPSTF GQGTRLEIK               109

HC for Fab M284-A06
                                                     (SEQ ID NO: 271)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M283-B06
                                                     (SEQ ID NO: 272)
QDIQMTQSPG TLSLSPGERA TLSCRASQSL SGNYLAWYQQ KPGQAPRLLI YGASSRATGV    60
SDRFSGSGSG TDFTLTISRL EPEDFAVYYC QQRSNWPITF GQGTRLEIK               109

HC for Fab M283-B06
                                                     (SEQ ID NO: 273)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M286-H01
                                                     (SEQ ID NO: 274)
QDIQMTQSPG TLSLSPGERA TLSCRASQSV ARYLAWYQQK PGQAPRLLIY GVSRRGTGIP    60
DRFSGSGSGT DFTLTISSLE PEDFAVYYCQ QRRKWPVTFG PGTKVDIK                108

HC for Fab M286-H01
                                                     (SEQ ID NO: 275)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M294-C09
                                                     (SEQ ID NO: 276)
QDIQMTQSPG TLSLSPGERA TLSCRASQSV GADLAWYQQK PGQAPRLLIY HASTRATGVP    60
ARFSGSGSGS EFTLAISSLQ SEDFAVYFCQ QRGFWPITFG QGTRLEIK                108
```

-continued

HC for Fab M294-C09

(SEQ ID NO: 277)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M297-A02

(SEQ ID NO: 278)
QDIQMTQSPG TLSLSPGERA TLSCRASQSV GSDLAWYQQK PGQAPRLLIY GASTRATGIP    60
GRFSGSGSGT EFTLTISSLE PEDFGVYYCQ QRRSWPPTFG GGTKVEIK                108

HC for Fab M297-A02

(SEQ ID NO: 279)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M283-B05

(SEQ ID NO: 280)
QDIQMTQSPG TLSLSPGERA TLSCRASQSV GSDLAWYQQN PGQAPRLLIY GTSTRATGIP    60
ARFSGSGSGT DFTLTISSLQ SEDFAVYFCQ QRGNWPITFG QGTRLEIK                108

HC for Fab M283-B05

(SEQ ID NO: 281)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M295-A04

(SEQ ID NO: 282)
QDIQMTQSPG TLSLSPGERA TLSCRASQSV GSNFLAWYQQ KPGQAPRLLI KGASSRASGI    60
PDRFSGSGSG TDFTLTISRV EPEDFAVYYC QQRSSWPITF GQGTRLDIK               109

HC for Fab M295-A04

(SEQ ID NO: 283)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M278-D02

(SEQ ID NO: 284)
QDIQMTQSPG TLSLSPGERA TLSCRASQSV NSNLAWYQQK PGQAPRLLH EASNRATGIP     60
DRFSGSGSER DFTLTISRLE PEDFAMYYCQ QRAYWPVSFG GGTKVEIK                108

HC for Fab M278-D02

(SEQ ID NO: 285)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M280-C11

(SEQ ID NO: 286)
QDIQMTQSPG TLSLSPGERA TLSCRASQSV SRHLAWYQQK PGQAPRLLIY GASNRATGIP    60
ARFSGSGSGT DFTLTISSLE SEDFAVYYCQ QRYNWPITFG QGTRLEIK                108

HC for Fab M280-C11

(SEQ ID NO: 287)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M281-F10

(SEQ ID NO: 288)
QDIQMTQSPG TLSLSPGERA TLSCRASQSV SSDVAWYQQR PGQAPRLLY GASARATGVP     60
ARFSGSGSGT EFTLTISSLE PEDFAVYYCQ QRGNWPITFG QGTRLEIK                108

HC for Fab M281-F10

(SEQ ID NO: 289)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M297-G08

(SEQ ID NO: 290)
QDIQMTQSPG TLSLSPGERA TLSCRASQSV SSNLAWYQQK PGQAPRLLIY DASYRATGIP    60
ARFSGSGSGT DFTLTISSLE PEDYAVYYCQ QRGNWPITFG QGTRLEIK                108

HC for Fab M297-G08

(SEQ ID NO: 291)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M279-G06

(SEQ ID NO: 292)
QDIQMTQSPG TLSLSPGERA TLSCRASQSV SSSHLAWYQQ KPGQAPRLLI YGASNRATGI     60
PDRFSGSGSG TDFTLTISSL EPEDFAVYYC QQRRNWPPTF GQGTKLEIK                109

HC for Fab M279-G06

(SEQ ID NO: 293)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M287-F09

(SEQ ID NO: 294)
QDIQMTQSPG TLSLSPGERA TLSCRASQSV SSSQIAWYQQ KPGQAPTILI YGASYRATGI     60
PDRFSGSGSG TDFTLTISSL EPEDFAVYYC QQRSNWPVTF GGGTKVEIK                109

HC for Fab M287-F09

(SEQ ID NO: 295)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M279-C02

(SEQ ID NO: 296)
QDIQMTQSPG TLSLSPGERA TLSCRASQSV SSSQLAWYQQ KPGQAPRLLI YGASNRATAI     60
PARFSGSGSG TDFTLTISSL EPDDSAVYYC QQRSRWPITF GQGTRLEIK                109

HC for Fab M279-C02

(SEQ ID NO: 297)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M287-H12

(SEQ ID NO: 298)
QDIQMTQSPG TLSLSPGERA TLSCRASQSV SSSQLAWYQQ KPGQAPRLLI YGASNRATGI     60
PARFSGSGSG TDFTLTISSL EPEDFAVYYC QQRSNWPVTF GGGTKVEIK                109

HC for Fab M287-H12

(SEQ ID NO: 299)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M278-E01

(SEQ ID NO: 300)
QDIQMTQSPG TLSLSPGERA TLSCRASQSV SSSQLAWYQQ KPGQAPRLLI YGASSRATGI     60
PDRFSGSGSG TDFTLTISRL EPEDFAVYYC QQRGNWPITF GQGTRLEIK                109

HC for Fab M278-E01

(SEQ ID NO: 301)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M286-D06

(SEQ ID NO: 302)
QDIQMTQSPG TLSLSPGERA TLSCRASQSV SSSQLAWYQQ KPGQAPSLLI YGASNRATGI     60
PDRFSGSGSG TDFTLTISSL EPEDFAVYYC QQRSNWPVTF GQGTRLEIK                109

HC for Fab M286-D06

(SEQ ID NO: 303)
EVQLLESGGG LVQPGGSLRL SCAASGFTFS QYPMWWVRQA PGKGLEWVSY IVPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M283-G08

(SEQ ID NO: 304)
QDIQMTQSPG TLSLSPGERA TLSCRASQSV SSSYLAWYQQ KPGQAPRLLI YDASSRATGI     60
PDRFSGSGSG TDFTLTISSL EPEDFAVYYC QQRHTWPITF GQGTRLEIK                109

HC for Fab M283-G08

(SEQ ID NO: 305)

```
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124
```

LC for Fab M279-A11

(SEQ ID NO: 306)

```
QDIQMTQSPG TLSLSPGERG TLSCRASQSV DNHLAWYQHK PGQAPRLLIY GASTRATGIP    60
ARFSGSGSGT DFTLTISSLE PEDFAVYYCQ QRRKWPVTFG GGTKVEIK               108
```

HC for Fab M279-A11

(SEQ ID NO: 307)

```
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124
```

LC for Fab M287-C11

(SEQ ID NO: 308)

```
QDIQMTQSPG TLSLSPGETA TLSCRASQPV GSYLAWYQQK PGQAPRLLIY GASNRATGIP    60
ARFSGSGSGT DFTLAISSLE PEDFAVYYCQ QRSNWPITFG QGTRLEIK               108
```

HC for Fab M287-C11

(SEQ ID NO: 309)

```
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124
```

LC for Fab M283-D05

(SEQ ID NO: 310)

```
QDIQMTQSPG TLSLSPGETA TLSCRASQSL GRSDLAWYQQ LPGQAPRLLI FGVSNRATGI    60
PARFSGSGSG TDFTLTISSL EPEDFAIYYC QQRSNWPVTF GPGTKVDFR              109
```

HC for Fab M283-D05

(SEQ ID NO: 311)

```
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124
```

LC for Fab M287-C05

(SEQ ID NO: 312)

```
QDIQMTQSPG TLSLSPGETA TLSCRASQSV SLYLAWYQQK PGQAPRLLIY GASSRATGIP    60
DRFSGSGSGT DFTLTISRLE PEDFAVYYCQ QRGSWPITFG QGTRLEIK               108
```

HC for Fab M287-C05

(SEQ ID NO: 313)

```
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124
```

LC for Fab M294-B11

(SEQ ID NO: 314)

```
QDIQMTQSPG TLSVSPGERA TLSCRASQDV NRYLAWYQQK PGQPPRLLIY GASTRATGIP    60
ARFSGSGSGT DFTLTISSLE PEDFAVYYCQ QRSNWPITFG QGTRLEIK               108
```

HC for Fab M294-B11

(SEQ ID NO: 315)

```
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124
```

LC for Fab M282-G10

(SEQ ID NO: 316)

```
QDIQMTQSPG TLSVSPGERA TLSCRASQSL NSDLAWYQQK PGQAPRLLIY GASTRATGVP    60
DRFTGSGSGT DFTLTISSLQ SEDLAVYYCQ QRRNWPITFG QGTRLEIK               108
```

HC for Fab M282-G10

(SEQ ID NO: 317)

```
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                               124
```

LC for Fab M278-E08

(SEQ ID NO: 318)

```
QDIQMTQSPG TLSVSPGERA TLSCRASQSV GSDLAWYQQK PGQAPRLLIY GASTRAIGIP    60
ARFSGSGSGT DFTLTISSLE PEDFAVYFCQ QRGNWPITFG QGTRLEIK               108
```

-continued

HC for Fab M278-E08
(SEQ ID NO: 319)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M281-H01
(SEQ ID NO: 320)
QDIQMTQSPG TLSVSPGERA TLSCRASQSV SSNLAWYQQK PGQAPRLLIY GASTRATGIP    60
ARFSGSGSGT DFTLTISSLE PEDFAVYFCQ QRGFWPITFG QGTRLEIK               108

HC for Fab M281-H01
(SEQ ID NO: 321)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M288-C08
(SEQ ID NO: 322)
QDIQMTQSPG TLSVSPGERV TLSCRASQSV SSYLAWYQQK PGQAPRLLIY GASTRVTGIP    60
ARFSGSGSGT EFTLTISSLQ SEDFAVYYCQ QRSSWPITFG QGTRLEIK               108

HC for Fab M288-C08
(SEQ ID NO: 323)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M287-C07
(SEQ ID NO: 324)
QDIQMTQSPG TMSLSPGEGA TLSCRASQTV SSRLLAWYQK KPAQAPRLLM YAASIRATGI    60
PDRFSGSGSG TDFTLTISRL EPEDFAVYFC QQRRSWPPTF GQGTKVEIK              109

HC for Fab M287-C07
(SEQ ID NO: 325)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M293-E03
(SEQ ID NO: 326)
QDIQMTQSPS FLSASLGDRV TITCRATQGI GTFLAWYQQK AGRAPKLLIY GASTLQSGVP    60
SRFSGSGSGT DFTLTISSLE PEDFAVYFCQ QRGNWPITFG QGTRLEIK               108

HC for Fab M293-E03
(SEQ ID NO: 327)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M286-B08
(SEQ ID NO: 328)
QDIQMTQSPS FLSASLGDRV TITCRATQGI GTFLAWYQQK AGRAPKLLIY GASTLQSGVP    60
SRFSGSGSGT EFTLTISSLQ PEDFATYYCQ QRGNWPITFG QGTRLEIK               108

HC for Fab M286-B08
(SEQ ID NO: 329)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M282-D10
(SEQ ID NO: 330)
QDIQMTQSPS FLSASVGDRV TITCRASQDI SSYLAWYQQK PGKAPKLLIY GASTLQSGVP    60
SRFSGSGSGT EFTLTISSLQ PEDFAVYYCQ QRGNWPITFG QGTRLEIK               108

HC for Fab M282-D10
(SEQ ID NO: 331)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M283-C03
(SEQ ID NO: 332)
QDIQMTQSPS FLSASVGDRV TITCRASQGI SSYLAWYQQK PGKAPKLLIY AASTLQSGVP    60
SRFSGSGSGT EFTLTISSLQ PEDFATYYCQ QRSNWPPSFG PGTKVDIK               108

HC for Fab M283-C03

(SEQ ID NO: 333)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M287-G06

(SEQ ID NO: 334)
QDIQMTQSPS SLSASVGDRV TITCRASQGI RNDVGWYQQK PGKAPKLLIY APSNLQSGVP    60
PRFSGSASGT DFTLTISSLQ PEDFATYYCL QDFDFPWTFG QGTKVEIK                108

HC for Fab M287-G06

(SEQ ID NO: 335)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M281-C02

(SEQ ID NO: 336)
QDIQMTQSPS SLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M281-C02

(SEQ ID NO: 337)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M282-A06

(SEQ ID NO: 338)
QDIQMTQSPS SLSVSPGERA TLSCRASQSV NSDLAWYQQR PGQAPRLLIY AASTRATGVP    60
ARFSGTGSGT EFTLTISSLE PEDFAVYYCQ QRRKWPVTFG GGTKVEIK                108

HC for Fab M282-A06

(SEQ ID NO: 339)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M280-C07

(SEQ ID NO: 340)
QDIQMTQSPS SVSASVGDRV TITCRASQGI STWLAWYQQK PGQAPRLLIY GASNRATGIP    60
DRFSGSGSGT DFTLTISRLE PEDFAVYFCQ QRGNWPITFG QGTRLEIK                108

HC for Fab M280-C07

(SEQ ID NO: 341)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M287-G10

(SEQ ID NO: 342)
QDIQMTQSPS TLSASVGDRV NITCRASQTI SSWLAWYQQK PGKAPKLLIY KASSLQSGVP    60
SRFSGSGSGT DFTLTISSLQ PEDFATYYCQ QYSSWYTFGQ GTKLEIK                 107

HC for Fab M287-G10

(SEQ ID NO: 343)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M278-D11

(SEQ ID NO: 344)
QDIQMTQSPS TLSLSPGERA TLSCRASQNV HTYLAWYQQK PGQAPRLLIS EASNRATGVP    60
ARFTGSGSGI DFSLSISSLE PEDFAIYYCQ QRGGWPITFG GGTKVEIK                108

HC for Fab M278-D11

(SEQ ID NO: 345)
EVQLLESGGG LVQPGGSLRL SCAASGFTFS QYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124

LC for Fab M287-F02

(SEQ ID NO: 346)
QDIQMTQSPV TLSVSPGERA TLSCRASQNI GSDLAWYQQQ PGQAPRLLIY RASFRATGIP    60
ARFSGSGSGT DFTLTISSLE PEDFAVYYCQ QRGFWPLTFG AGTKVEIK                108

HC for Fab M287-F02

(SEQ ID NO: 347)
```
EVQLLESGGG LVQPGGSLRL SCAASGFTFS QYPMWWVRQA PGKGLEWVSY IVPSGGRTYY      60
ADSVKGRFTI SRDNSKNTLY LQMNSLRAED TAVYYCAKDR AYGDYVGWNG FDYWGQGTLV     120
TVSS                                                                 124
```

LC for Fab M269-C02

(SEQ ID NO: 348)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M269-C02

(SEQ ID NO: 349)
```
EVQLLESGGG LVQPGASLRL SCAASGFTFS TYPMWWVRQA PGKGLEWVSY ISSSGGGTYY      60
ADSVKGRFTI SRDNSKNTLY LQMNSLRAED TAVYYCAKDR AYGDYVGWNG FDYWGQGTLV     120
TVSS                                                                 124
```

LC for Fab M277-C02

(SEQ ID NO: 350)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M277-C02

(SEQ ID NO: 351)
```
EVQLLESGGG LVQPGGSLRL SCAASGFTFS AYDMIWVRQA PGKGLEWVSY IVPSGGTDY       60
ADSVKGRFTI SRDNSKNTLY LQMNSLRAED TAVYYCAKDR AYGDYVGWNG FDYWGQGTLV     120
TVSS                                                                 124
```

LC for Fab M272-H08

(SEQ ID NO: 352)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M272-H08

(SEQ ID NO: 353)
```
EVQLLESGGG LVQPGGSLRL SCAASGFTFS AYDMWWVRQA PGKGLEWVSV IYPSGGTTFY      60
ADSVKGRFTI SRDNSKNTLY LQMNSLRAED TAVYYCAKDR AYGDYVGWNG FDYWGQGTLV     120
TVSS                                                                 124
```

LC for Fab M271-D10

(SEQ ID NO: 354)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M271-D10

(SEQ ID NO: 355)
```
EVQLLESGGG LVQPGGSLRL SCAASGFTFS AYDMWWVRQA PGKGLEWVSV IYSSGGMTLY      60
ADSVKGRFTI SRDNSKNTLY LQMNSLRAED TAVYYCAKDR AYGDYVGWNG FDYWGQGTLV     120
TVSS                                                                 124
```

LC for Fab M271-E12

(SEQ ID NO: 356)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M271-E12

(SEQ ID NO: 357)
```
EVQLLESGGG LVQPGGSLRL SCAASGFTFS AYDMWWVRQA PGKGLEWVSY ISSSGGFTDY      60
ADSVKGRFTI SRDNSKNTLY LQMNSLRAED TAVYYCAKDR AYGDYVGWNG FDYWGQGTLV     120
TVSS                                                                 124
```

LC for Fab M269-C06

(SEQ ID NO: 358)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M269-C06

(SEQ ID NO: 359)
```
EVQLLESGGG LVQPGGSLRL SCAASGFTFS AYEMWWVRQA PGKGLEWVSS IYPSGGYTDY      60
ADSVKGRFTI SRDNSKNTLY LQMNSLRAED TAVYYCAKDR AYGDYVGWNG FDYWGQGTLV     120
TVSS                                                                 124
```

LC for Fab M271-G01

(SEQ ID NO: 360)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

-continued

HC for Fab M271-G01

(SEQ ID NO: 361)
```
EVQLLESGGG LVQPGGSLRL SCAASGFTFS AYEMWWVRQA PGKGLEWVSV IYPSGGGTFY      60
ADSVKGRFTI SRDNSKNTLY LQMNSLRAED TAVYYCAKDR AYGDYVGWNG FDYWGQGTLV     120
TVSS                                                                 124
```

LC for Fab M270-F03

(SEQ ID NO: 362)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M270-F03

(SEQ ID NO: 363)
```
EVQLLESGGG LVQPGGSLRL SCAASGFTFS AYMMWWVRQA PGKGLEWVSA ISPSGGYTGY      60
ADSVKGRFTI SRDNSKNTLY LQMNSLRAED TAVYYCAKDR AYGDYVGWNG FDYWGQGTLV     120
TVSS                                                                 124
```

LC for Fab M270-G04

(SEQ ID NO: 364)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M270-G04

(SEQ ID NO: 365)
```
EVQLLESGGG LVQPGGSLRL SCAASGFTFS AYNMIWVRQA PGKGLEWVSY IVPSGGFTGY      60
ADSVKGRFTI SRDNSKNTLY LQMNSLRAED TAVYYCAKDR AYGDYVGWNG FDYWGQGTLV     120
TVSS                                                                 124
```

LC for Fab M268-E01

(SEQ ID NO: 366)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M268-E01

(SEQ ID NO: 367)
```
EVQLLESGGG LVQPGGSLRL SCAASGFTFS AYPMIWVRQA PGKGLEWVSY IVPSGGATFY      60
ADSVKGRFTI SRDNSKNTLY LQMNSLRAED TAVYYCAKDR AYGDYVGWNG FDYWGQGTLV     120
TVSS                                                                 124
```

LC for Fab M269-E07

(SEQ ID NO: 368)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M269-E07

(SEQ ID NO: 369)
```
EVQLLESGGG LVQPGGSLRL SCAASGFTFS AYPMMWVRQA PGKGLEWVSY IYPSGGGTFY      60
ADSVKGRFTI SRDNSKNTLY LQMNSLRAED TAVYYCAKDR AYGDYVGWNG FDYWGQGTLV     120
TVSS                                                                 124
```

HC for Fab M299-C10

(SEQ ID NO: 370)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M299-C10

(SEQ ID NO: 371)
```
EVQLLESGGG LVQPGGSLRL SCAASGFTFS AYPMWWVRQA PGKGLEWVSY IVPSGGMTYY      60
ADSVKGRFTI SRDNSKNTLY LQMNSLRAED TAVYYCAKDR AYGDYVGWNG FDYWGQGTLV     120
TVSS                                                                 124
```

LC for Fab M274-D05

(SEQ ID NO: 372)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M274-D05

(SEQ ID NO: 373)
```
EVQLLESGGG LVQPGGSLRL SCAASGFTFS AYPMWWVRQA PGKGLEWVSY IYPSGGATFY      60
ADSVKGRFTI SRDNSKNTLY LQMNSLRAED TAVYYCAKDR AYGDYVGWNG FDYWGQGTLV     120
TVSS                                                                 124
```

LC for Fab M300-F10

(SEQ ID NO: 374)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M300-F10

(SEQ ID NO: 375)
EVQLLESGGG LVQPGGSLRL SCAASGFTFS DYAMWWVRQA PGKGLEWVSS IYPSGGATFY    60
ADSVKGRFTI SRDNSKNTLY LQMNSLRAED TAVYYCAKDR AYGDYVGWNG FDYWGQGTLV   120
TVSS                                                                124

LC for Fab M269-D11

(SEQ ID NO: 376)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M269-D11

(SEQ ID NO: 377)
EVQLLESGGG LVQPGGSLRL SCAASGFTFS DYAMWWVRQA PGKGLEWVSS ISPSGGGTLY    60
ADSVKGRFTI SRDNSKNTLY LQMNSLRAED TAVYYCAKDR AYGDYVGWNG FDYWGQGTLV   120
TVSS                                                                124

LC for Fab M271-D08

(SEQ ID NO: 378)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M271-D08

(SEQ ID NO: 379)
EVQLLESGGG LVQPGGSLRL SCAASGFTFS DYDMFWVRQA PGKGLEWVSG IVSSGGYTGY    60
ADSVKGRFTI SRDNSKNTLY LQMNSLRAED TAVYYCAKDR AYGDYVGWNG FDYWGQGTLV   120
TVSS                                                                124

LC for Fab M268-A12

(SEQ ID NO: 380)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M268-A12

(SEQ ID NO: 381)
EVQLLESGGG LVQPGGSLRL SCAASGFTFS DYDMWWVRQA PGKGLEWVSV ISPSGGYTGY    60
ADSVKGRFTI SRDNSKNTLY LQMNSLRAED TAVYYCAKDR AYGDYVGWNG FDYWGQGTLV   120
TVSS                                                                124

LC for Fab M277-A06

(SEQ ID NO: 382)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M277-A06

(SEQ ID NO: 383)
EVQLLESGGG LVQPGGSLRL SCAASGFTFS DYDMWWVRQA PGKGLEWVSV IYPSGGFTGY    60
ADSVKGRFTI SRDNSKNTLY LQMNSLRAED TAVYYCAKDR AYGDYVGWNG FDYWGQGTLV   120
TVSS                                                                124

LC for Fab M272-E06

(SEQ ID NO: 384)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M272-E06

(SEQ ID NO: 385)
EVQLLESGGG LVQPGGSLRL SCAASGFTFS DYDMWWVRQA PGKGLEWVSV IYSGGSTYYA    60
DSVKGRFTIS RDNSKNTLYL QMNSLRAEDT AVYYCAKDRA YGDYVGWNGF DYWGQGTLVT   120
VSS                                                                 123

LC for Fab M271-A10

(SEQ ID NO: 386)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M271-A10

(SEQ ID NO: 387)
EVQLLESGGG LVQPGGSLRL SCAASGFTFS DYDMWWVRQA PGKGLEWVSV IYSSGGFTSY    60
ADSVKGRFTI SRDNSKNTLY LQMNSLRAED TAVYYCAKDR AYGDYVGWNG FDYWGQGTLV   120
TVSS                                                                124

LC for Fab M275-E06

(SEQ ID NO: 388)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

-continued

HC for Fab M275-E06

(SEQ ID NO: 389)
```
EVQLLESGGG LVQPGGSLRL SCAASGFTFS DYDMWWVRQA PGKGLEWVSV IYSSGGMTYY    60
ADSVKGRFTI SRDNSKNTLY LQMNSLRAED TAVYYCAKDR AYGDYVGWNG FDYWGQGTLV   120
TVSS                                                              124
```

LC for Fab M277-E12

(SEQ ID NO: 390)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M277-E12

(SEQ ID NO: 391)
```
EVQLLESGGG LVQPGGSLRL SCAASGFTFS DYMMWWVRQA PGKGLEWVSS ISPSGGFTDY    60
ADSVKGRFTI SRDNSKNTLY LQMNSLRAED TAVYYCAKDR AYGDYVGWNG FDYWGQGTLV   120
TVSS                                                              124
```

LC for Fab M269-B06

(SEQ ID NO: 392)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M269-B06

(SEQ ID NO: 393)
```
EVQLLESGGG LVQPGGSLRL SCAASGFTFS DYNMWWVRQA PGKGLEWVSV IYPSGGWTMY    60
ADSVKGRFTI SRDNSKNTLY LQMNSLRAED TAVYYCAKDR AYGDYVGWNG FDYWGQGTLV   120
TVSS                                                              124
```

LC for Fab M271-B04

(SEQ ID NO: 394)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M271-B04

(SEQ ID NO: 395)
```
EVQLLESGGG LVQPGGSLRL SCAASGFTFS DYPMFWVRQA PGKGLEWVSY IVPSGGWTDY    60
ADSVKGRFTI SRDNSKNTLY LQMNSLRAED TAVYYCAKDR AYGDYVGWNG FDYWGQGTLV   120
TVSS                                                              124
```

LC for Fab M306-C02

(SEQ ID NO: 396)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M306-C02

(SEQ ID NO: 397)
```
EVQLLESGGG LVQPGGSLRL SCAASGFTFS DYPMFWVRQA PGKGLEWVSY IVPSGGWTSY    60
ADSVKGRFTI SRDNSKNTLY LQMNSLRAED TAVYYCAKDR AYGDYVGWNG FDYWGQGTLV   120
TVSS                                                              124
```

LC for Fab M277-G06

(SEQ ID NO: 398)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M277-G06

(SEQ ID NO: 399)
```
EVQLLESGGG LVQPGGSLRL SCAASGFTFS DYPMIWVRQA PGKGLEWVSY ISPSGGYTDY    60
ADSVKGRFTI SRDNSKNTLY LQMNSLRAED TAVYYCAKDR AYGDYVGWNG FDYWGQGTLV   120
TVSS                                                              124
```

LC for Fab M277-G04

(SEQ ID NO: 400)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M277-G04

(SEQ ID NO: 401)
```
EVQLLESGGG LVQPGGSLRL SCAASGFTFS DYPMIWVRQA PGKGLEWVSY IVPSGGWTDY    60
ADSVKGRFTI SRDNSKNTLY LQMNSLRAED TAVYYCAKDR AYGDYVGWNG FDYWGQGTLV   120
TVSS                                                              124
```

LC for Fab M298-C05

(SEQ ID NO: 402)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M298-C05

(SEQ ID NO: 403)
EVQLLESGGG LVQPGGSLRL SCAASGFTFS DYPMIWVRQA PGKGLEWVSY IYPSGGGTYY  60
ADSVKGRFTI SRDNSKNTLY LQMNSLRAED TAVYYCAKDR AYGDYVGWNG FDYWGQGTLV  120
TVSS  124

LC for Fab M268-C12

(SEQ ID NO: 404)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK  108

HC for Fab M268-C12

(SEQ ID NO: 405)
EVQLLESGGG LVQPGGSLRL SCAASGFTFS DYPMWWVRQA PGKGLEWVSY ISSSGGWTSY  60
ADSVKGRFTI SRDNSKNTLY LQMNSLRAED TAVYYCAKDR AYGDYVGWNG FDYWGQGTLV  120
TVSS  124

LC for Fab M269-F03

(SEQ ID NO: 406)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK  108

HC for Fab M269-F03

(SEQ ID NO: 407)
EVQLLESGGG LVQPGGSLRL SCAASGFTFS DYPMWWVRQA PGKGLEWVSY IYPSGGATYY  60
ADSVKGRFTI SRDNSKNTLY LQMNSLRAED TAVYYCAKDR AYGDYVGWNG FDYWGQGTLV  120
TVSS  124

LC for Fab M271-A08

(SEQ ID NO: 408)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK  108

HC for Fab M271-A08

(SEQ ID NO: 409)
EVQLLESGGG LVQPGGSLRL SCAASGFTFS DYQMWWVRQA PGKGLEWVSV IYPSGGATFY  60
ADSVKGRFTI SRDNSKNTLY LQMNSLRAED TAVYYCAKDR AYGDYVGWNG FDYWGQGTLV  120
TVSS  124

LC for Fab M272-D08

(SEQ ID NO: 410)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK  108

HC for Fab M272-D08

(SEQ ID NO: 411)
EVQLLESGGG LVQPGGSLRL SCAASGFTFS EYDMWWVRQA PGKGLEWVSV IYPSGGPTYY  60
ADSVKGRFTI SRDNSKNTLY LQMNSLRAED TAVYYCAKDR AYGDYVGWNG FDYWGQGTLV  120
TVSS  124

LC for Fab M275-G03

(SEQ ID NO: 412)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK  108

HC for Fab M275-G03

(SEQ ID NO: 413)
EVQLLESGGG LVQPGGSLRL SCAASGFTFS EYDMWWVRQA PGKGLEWVSV IYSSGGYTGY  60
ADSVKGRFTI SRDNSKNTLY LQMNSLRAED TAVYYCAKDR AYGDYVGWNG FDYWGQGTLV  120
TVSS  124

LC for Fab M271-A11

(SEQ ID NO: 414)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK  108

HC for Fab M271-A11

(SEQ ID NO: 415)
EVQLLESGGG LVQPGGSLRL SCAASGFTFS EYEMWWVRQA PGKGLEWVSV IYPSGGYTNY  60
ADSVKGRFTI SRDNSKNTLY LQMNSLRAED TAVYYCAKDR AYGDYVGWNG FDYWGQGTLV  120
TVSS  124

LC for Fab M269-G06

(SEQ ID NO: 416)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK  108

-continued

HC for Fab M269-G06

(SEQ ID NO: 417)
EVQLLESGGG LVQPGGSLRL SCAASGFTFS EYNMWWVRQA PGKGLEWVSV IYPSGGPTWY      60
ADSVKGRFTI SRDNSKNTLY LQMNSLRAED TAVYYCAKDR AYGDYVGWNG FDYWGQGTLV     120
TVSS                                                                  124

LC for Fab M272-E03

(SEQ ID NO: 418)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M272-E03

(SEQ ID NO: 419)
EVQLLESGGG LVQPGGSLRL SCAASGFTFS EYPMFWVRQA PGKGLEWVSY ISPSGGWTSY      60
ADSVKGRFTI SRDNSKNTLY LQMNSLRAED TAVYYCAKDR AYGDYVGWNG FDYWGQGTLV     120
TVSS                                                                  124

LC for Fab M276-G10

(SEQ ID NO: 420)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M276-G10

(SEQ ID NO: 421)
EVQLLESGGG LVQPGGSLRL SCAASGFTFS EYPMIWVRQA PGKGLEWVSY ISPSGGYTGY      60
ADSVKGRFTI SRDNSKNTLY LQMNSLRAED TAVYYCAKDR AYGDYVGWNG FDYWGQGTLV     120
TVSS                                                                  124

LC for Fab M269-H08

(SEQ ID NO: 422)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M269-H08

(SEQ ID NO: 423)
EVQLLESGGG LVQPGGSLRL SCAASGFTFS EYPMWWVRQA PGKGLEWVSS IYPSGGATFY      60
ADSVKGRFTI SRDNSKNTLY LQMNSLRAED TAVYYCAKDR AYGDYVGWNG FDYWGQGTLV     120
TVSS                                                                  124

LC for Fab M300-A11

(SEQ ID NO: 424)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M300-A11

(SEQ ID NO: 425)
EVQLLESGGG LVQPGGSLRL SCAASGFTFS EYWMWVRQA PGKGLEWVSS ISPSGGGTFY       60
ADSVKGRFTI SRDNSKNTLY LQMNSLRAED TAVYYCAKDR AYGDYVGWNG FDYWGQGTLV     120
TVSS                                                                  124

LC for Fab M274-D02

(SEQ ID NO: 426)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M274-D02

(SEQ ID NO: 427)
EVQLLESGGG LVQPGGSLRL SCAASGFTFS FYDMFWVRQA PGKGLEWVSV ISSSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M269-H01

(SEQ ID NO: 428)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M269-H01

(SEQ ID NO: 429)
EVQLLESGGG LVQPGGSLRL SCAASGFTFS FYDMLWVRQA PGKGLEWVSY ISSSGGFTGY      60
ADSVKGRFTI SRDNSKNTLY LQMNSLRAED TAVYYCAKDR AYGDYVGWNG FDYWGQGTLV     120
TVSS                                                                  124

LC for Fab M272-D07

(SEQ ID NO: 430)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

```
HC for Fab M272-D07
                                                       (SEQ ID NO: 431)
EVQLLESGGG LVQPGGSLRL SCAASGFTFS FYDMWWVRQA PGKGLEWVSS IYSSGGATFY     60
ADSVKGRFTI SRDNSKNTLY LQMNSLRAED TAVYYCAKDR AYGDYVGWNG FDYWGQGTLV    180
TVSS                                                                124

LC for Fab M271-A12
                                                       (SEQ ID NO: 432)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M271-A12
                                                       (SEQ ID NO: 433)
EVQLLESGGG LVQPGGSLRL SCAASGFTFS FYDMWWVRQA PGKGLEWVSV IYSSGGATFY     60
ADSVKGRFTI SRDNSKNTLY LQMNSLRAED TAVYYCAKDR AYGDYVGWNG FDYWGQGTLV    120
TVSS                                                                124

LC for Fab M270-G05
                                                       (SEQ ID NO: 434)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M270-G05
                                                       (SEQ ID NO: 435)
EVQLLESGGG LVQPGGSLRL SCAASGFTFS FYDMWWVRQA PGKGLEWVSV IYSSGGFTDY     60
ADSVKGRFTI SRDNSKNTLY LQMNSLRAED TAVYYCAKDR AYGDYVGWNG FDYWGQGTLV    120
TVSS                                                                124

LC for Fab M270-C10
                                                       (SEQ ID NO: 436)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M270-C10
                                                       (SEQ ID NO: 437)
EVQLLESGGG LVQPGGSLRL SCAASGFTFS FYDMWWVRQA PGKGLEWVSY ISSSGGGTFY     60
ADSVKGRFTI SRDNSKNTLY LQMNSLRAED TAVYYCAKDR AYGDYVGWNG FDYWGQGTLV    120
TVSS                                                                124

LC for Fab M269-D09
                                                       (SEQ ID NO: 438)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-D09
                                                       (SEQ ID NO: 439)
EVQLLESGGG LVQPGGSLRL SCAASGFTFS FYDMYWVRQA PGKGLEWVSS IVPSGGATFY     60
ADSVKGRFTI SRDNSKNTLY LQMNSLRAED TAVYYCAKDR AYGDYVGWNG FDYWGQGTLV    120
TVSS                                                                124

LC for Fab M277-B07
                                                       (SEQ ID NO: 440)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M277-B07
                                                       (SEQ ID NO: 441)
EVQLLESGGG LVQPGGSLRL SCAASGFTFS FYEMWWVRQA PGKGLEWVSY ISPSGGGTYY     60
ADSVKGRFTI SRDNSKNTLY LQMNSLRAED TAVYYCAKDR AYGDYVGWNG FDYWGQGTLV    120
TVSS                                                                124

LC for Fab M300-H04
                                                       (SEQ ID NO: 442)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M300-H04
                                                       (SEQ ID NO: 443)
EVQLLESGGG LVQPGGSLRL SCAASGFTFS FYHMIWVRQA PGKGLEWVSY IYSSGTFYA      60
DSVKGRFTIS RDNSKNTLYL QMNSLRAEDT AVYYCAKDRA YGDYVGWNGF DYWGQGTLVT    120
VSS                                                                 123

LC for Fab M271-H08
                                                       (SEQ ID NO: 444)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108
```

```
HC for Fab M271-H08
                                                            (SEQ ID NO: 445)
EVQLLESGGG LVQPGGSLRL SCAASGFTFS FYMMWWVRQA PGKGLEWVSS ISPSGGATFY        60
ADSVKGRFTI SRDNSKNTLY LQMNSLRAED TAVYYCAKDR AYGDYVGWNG FDYWGQGTLV       120
TVSS                                                                   124

LC for Fab M306-H03
                                                            (SEQ ID NO: 446)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M306-H03
                                                            (SEQ ID NO: 447)
EVQLLESGGG LVQPGGSLRL SCAASGFTFS FYNMWWVRQA PGKGLEWVSS ISPSGGGTFY        60
ADSVKGRFTI SRDNSKNTLY LQMNSLRAED TAVYYCAKDR AYGDYVGWNG FDYWGQGTLV       120
TVSS                                                                   124

LC for Fab M275-F06
                                                            (SEQ ID NO: 448)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M275-F06
                                                            (SEQ ID NO: 449)
EVQLLESGGG LVQPGGSLRL SCAASGFTFS FYNMWWVRQA PGKGLEWVSV IYPSGGKTYY        60
ADSVKGRFTI SRDNSKNTLY LQMNSLRAED TAVYYCAKDR AYGDYVGWNG FDYWGQGTLV       120
TVSS                                                                   124

LC for Fab M299-C08
                                                            (SEQ ID NO: 450)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M299-C08
                                                            (SEQ ID NO: 451)
EVQLLESGGG LVQPGGSLRL SCAASGFTFS FYNMWWVRQA PGKGLEWVSV IYPSGGPTFY        60
ADSVKGRFTI SRDNSKNTLY LQMNSLRAED TAVYYCAKDR AYGDYVGWNG FDYWGQGTLV       120
TVSS                                                                   124

LC for Fab M274-D08
                                                            (SEQ ID NO: 452)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M274-D08
                                                            (SEQ ID NO: 453)
EVQLLESGGG LVQPGGSLRL SCAASGFTFS FYPMIWVRQA PGKGLEWVSY ISPSGGSTLY        60
ADSVKGRFTI SRDNSKNTLY LQMNSLRAED TAVYYCAKDR AYGDYVGWNG FDYWGQGTLV       120
TVSS                                                                   124

LC for Fab M303-H07
                                                            (SEQ ID NO: 454)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M303-H07
                                                            (SEQ ID NO: 455)
EVQLLESGGG LVQPGGSLRL SCAASGFTFS FYPMIWVRQA PGKGLEWVSY ISSSGGFTDY        60
ADSVKGRFTI SRDNSKNTLY LQMNSLRAED TAVYYCAKDR AYGDYVGWNG FDYWGQGTLV       120
TVSS                                                                   124

LC for Fab M272-C10
                                                            (SEQ ID NO: 456)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M272-C10
                                                            (SEQ ID NO: 457)
EVQLLESGGG LVQPGGSLRL SCAASGFTFS FYPMIWVRQA PGKGLEWVSY ISSSGGYTSY        60
ADSVKGRFTI SRDNSKNTLY LQMNSLRAED TAVYYCAKDR AYGDYVGWNG FDYWGQGTLV       120
TVSS                                                                   124

LC for Fab M269-C08
                                                            (SEQ ID NO: 458)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108
```

-continued

HC for Fab M269-C08

(SEQ ID NO: 459)

```
EVQLLESGGG LVQPGGSLRL SCAASGFTFS FYPMLWVRQA PGKGLEWVSY ISGGYTGYAD      60
SVKGRFTISR DNSKNTLYLQ MNSLRAEDTA VYYCAKDRAY GDYVGWNGFD YWGQGTLVTV     120
SS                                                                   122
```

LC for Fab M270-F07

(SEQ ID NO: 460)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M270-F07

(SEQ ID NO: 461)

```
EVQLLESGGG LVQPGGSLRL SCAASGFTFS FYPMMWVRQA PGKGLEWVSY ISFSGGYTGY      60
ADSVKGRFTI SRDNSKNTLY LQMNSLRAED TAVYYCAKDR AYGDYVGWNG FDWGQGTLV     120
TVSS                                                                 124
```

LC for Fab M273-C10

(SEQ ID NO: 462)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M273-C10

(SEQ ID NO: 463)

```
EVQLLESGGG LVQPGGSLRL SCAASGFTFS FYPMWWVRQA PGKGLEWVSY IYPSGGATFY      60
ADSVKGRFTI SRDNSKNTLY LQMNSLRAED TAVYYCAKDR AYGDYVGWNG FDWGQGTLV     120
TVSS                                                                 124
```

LC for Fab M275-H08

(SEQ ID NO: 464)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M275-H08

(SEQ ID NO: 465)

```
EVQLLESGGG LVQPGGSLRL SCAASGFTFS GYDMWWVRQA PGKGLEWVSV ISPSGGGTFY      60
ADSVKGRFTI SRDNSKNTLY LQMNSLRAED TAVYYCAKDR AYGDYVGWNG FDWGQGTLV     120
TVSS                                                                 124
```

LC for Fab M269-C11

(SEQ ID NO: 466)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M269-C11

(SEQ ID NO: 467)

```
EVQLLESGGG LVQPGGSLRL SCAASGFTFS GYDMWWVRQA PGKGLEWVSV IYSSGGTTFY      60
ADSVKGRFTI SRDNSKNTLY LQMNSLRAED TAVYYCAKDR AYGDYVGWNG FDWGQGTLV     120
TVSS                                                                 124
```

LC for Fab M304-B05

(SEQ ID NO: 468)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M304-B05

(SEQ ID NO: 469)

```
EVQLLESGGG LVQPGGSLRL SCAASGFTFS GYNMWWVRQA PGKGLEWVSV IYPSGGATFY      60
ADSVKGRFTI SRDNSKNTLY LQMNSLRAED TAVYYCAKDR AYGDYVGWNG FDWGQGTLV     120
TVSS                                                                 124
```

LC for Fab M276-F12

(SEQ ID NO: 470)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M276-F12

(SEQ ID NO: 471)

```
EVQLLESGGG LVQPGGSLRL SCAASGFTFS GYPMWWVRQA PGKGLEWVSY ISSSGGTFY       60
ADSVKGRFTI SRDNSKNTLY LQMNSLRAED TAVYYCAKDR AYGDYVGWNG FDWGQGTLV     120
TVSS                                                                 124
```

LC for Fab M299-D06

(SEQ ID NO: 472)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M299-D06

(SEQ ID NO: 473)
EVQLLESGGG LVQPGGSLRL SCAASGFTFS HYAMIWVRQA PGKGLEWVSY IVPSGGWTDY    60
ADSVKGRFTI SRDNSKNTLY LQMNSLRAED TAVYYCAKDR AYGDYVGWNG FDYWGQGTLV   120
TVSS                                                                124

LC for Fab M271-G12

(SEQ ID NO: 474)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-G12

(SEQ ID NO: 475)
EVQLLESGGG LVQPGGSLRL SCAASGFTFS HYAMIWVRQA PGKGLEWVSY IVPSGGWTGY    60
ADSVKGRFTI SRDNSKNTLY LQMNSLRAED TAVYYCAKDR AYGDYVGWNG FDYWGQGTLV   120
TVSS                                                                124

LC for Fab M272-G11

(SEQ ID NO: 476)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M272-G11

(SEQ ID NO: 477)
EVQLLESGGG LVQPGGSLRL SCAASGFTFS HYDMWWVRQA PGKGLEWVSS ISPSGGATFY    60
ADSVKGRFTI SRDNSKNTLY LQMNSLRAED TAVYYCAKDR AYGDYVGWNG FDYWGQGTLV   120
TVSS                                                                124

LC for Fab M269-B12

(SEQ ID NO: 478)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M269-B12

(SEQ ID NO: 479)
EVQLLESGGG LVQPGGSLRL SCAASGFTFS HYDMWWVRQA PGKGLEWVSV IVSSGKTFYA    60
DSVKGRFTIS RDNSKNTLYL QMNSLRAEDT AVYYCAKDRA YGDYVGWNGF DYWGQGTLVT   120
VSS                                                                 123

LC for Fab M268-A01

(SEQ ID NO: 480)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M268-A01

(SEQ ID NO: 481)
EVQLLESGGG LVQPGGSLRL SCAASGFTFS HYDMWWVRQA PGKGLEWVSV IYPSGGFTDY    60
ADSVKGRFTI SRDNSKNTLY LQMNSLRAED TAVYYCAKDR AYGDYVGWNG FDYWGQGTLV   120
TVSS                                                                124

LC for Fab M277-B12

(SEQ ID NO: 482)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M277-B12

(SEQ ID NO: 483)
EVQLLESGGG LVQPGGSLRL SCAASGFTFS HYDMWWVRQA PGKGLEWVSV IYPSGGHTLY    60
ADSVKGRFTI SRDNSKNTLY LQMNSLRAED TAVYYCAKDR AYGDYVGWNG FDYWGQGTLV   120
TVSS                                                                124

LC for Fab M273-G07

(SEQ ID NO: 484)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M273-G07

(SEQ ID NO: 485)
EVQLLESGGG LVQPGGSLRL SCAASGFTFS HYDMWWVRQA PGKGLEWVSV IYPSGGPTYY    60
ADSVKGRFTI SRDNSKNTLY LQMNSLRAED TAVYYCAKDR AYGDYVGWNG FDYWGQGTLV   120
TVSS                                                                124

LC for Fab M274-F01

(SEQ ID NO: 486)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M274-F01

(SEQ ID NO: 487)

```
EVQLLESGGG LVQPGGSLRL SCAASGFTFS HYDMWWVRQA PGKGLEWVSV IYPSGGVTYY      60
ADSVKGRFTI SRDNSKNTLY LQMNSLRAED TAVYYCAKDR AYGDYVGWNG FDYWGQGTLV     120
TVSS                                                                 124
```

LC for Fab M275-E12

(SEQ ID NO: 488)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M275-E12

(SEQ ID NO: 489)

```
EVQLLESGGG LVQPGGSLRL SCAASGFTFS HYDMWWVRQA PGKGLEWVSV IYSSGGFTGY      60
ADSVKGRFTI SRDNSKNTLY LQMNSLRAED TAVYYCAKDR AYGDYVGWNG FDYWGQGTLV     120
TVSS                                                                 124
```

LC for Fab M298-E01

(SEQ ID NO: 490)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M298-E01

(SEQ ID NO: 491)

```
EVQLLESGGG LVQPGGSLRL SCAASGFTFS HYDMWWVRQA PGKGLEWVSV IYSSGGPTYY      60
ADSVKGRFTI SRDNSKNTLY LQMNSLRAED TAVYYCAKDR AYGDYVGWNG FDYWGQGTLV     120
TVSS                                                                 124
```

LC for Fab M274-G10

(SEQ ID NO: 492)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M274-G10

(SEQ ID NO: 493)

```
EVQLLESGGG LVQPGGSLRL SCAASGFTFS HYDMWWVRQA PGKGLEWVSY ISPSGGFTSY      60
ADSVKGRFTI SRDNSKNTLY LQMNSLRAED TAVYYCAKDR AYGDYVGWNG FDYWGQGTLV     120
TVSS                                                                 124
```

LC for Fab M268-G01

(SEQ ID NO: 494)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M268-G01

(SEQ ID NO: 495)

```
EVQLLESGGG LVQPGGSLRL SCAASGFTFS HYEMWWVRQA PGKGLEWVSS ISSSGGGTFY      60
ADSVKGRFTI SRDNSKNTLY LQMNSLRAED TAVYYCAKDR AYGDYVGWNG FDYWGQGTLV     120
TVSS                                                                 124
```

LC for Fab M269-H02

(SEQ ID NO: 496)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M269-H02

(SEQ ID NO: 497)

```
EVQLLESGGG LVQPGGSLRL SCAASGFTFS HYEMWWVRQA PGKGLEWVSY IGSSGGSTYY      60
ADSVKGRFTI SRDNSKNTLY LQMNSLRAED TAVYYCAKDR AYGDYVGWNG FDYWGQGTLV     120
TVSS                                                                 124
```

LC for Fab M277-G05

(SEQ ID NO: 498)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M277-G05

(SEQ ID NO: 499)

```
EVQLLESGGG LVQPGGSLRL SCAASGFTFS HYMMIWVRQA PGKGLEWVSG ISPSGGYTGY      60
ADSVKGRFTI SRDNSKNTLY LQMNSLRAED TAVYYCAKDR AYGDYVGWNG FDYWGQGTLV     120
TVSS                                                                 124
```

LC for Fab M271-H01

(SEQ ID NO: 500)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M271-H01

(SEQ ID NO: 501)
EVQLLESGGG LVQPGGSLRL SCAASGFTFS HYMMWWVRQA PGKGLEWVSS IYPSGGGTYY        60
ADSVKGRFTI SRDNSKNTLY LQMNSLRAED TAVYYCAKDR AYGDYVGWNG FDYWGQGTLV       120
TVSS                                                                    124

LC for Fab M303-F06

(SEQ ID NO: 502)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M303-F06

(SEQ ID NO: 503)
EVQLLESGGG LVQPGGSLRL SCAASGFTFS HYMMWWVRQA PGKGLEWVSS IYPSGGTYYA        60
DSVKGRFTIS RDNSKNTLYL QMNSLRAEDT AVYYCAKDRA YGDYVGWNGF DYWGQGTLVT       120
VSS                                                                     123

LC for Fab M272-B03

(SEQ ID NO: 504)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M272-B03

(SEQ ID NO: 505)
EVQLLESGGG LVQPGGSLRL SCAASGFTFS HYPMFWVRQA PGKGLEWVSY ISSSGGWTDY        60
ADSVKGRFTI SRDNSKNTLY LQMNSLRAED TAVYYCAKDR AYGDYVGWNG FDYWGQGTLV       120
TVSS                                                                    124

LC for Fab M272-B04

(SEQ ID NO: 506)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M272-B04

(SEQ ID NO: 507)
EVQLLESGGG LVQPGGSLRL SCAASGFTFS HYPMIWVRQA PGKGLEWVSY ISPSGGGTFY        60
ADSVKGRFTI SRDNSKNTLY LQMNSLRAED TAVYYCAKDR AYGDYVGWNG FDYWGQGTLV       120
TVSS                                                                    124

LC for Fab M272-H03

(SEQ ID NO: 508)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M272-H03

(SEQ ID NO: 509)
EVQLLESGGG LVQPGGSLRL SCAASGFTFS HYPMIWVRQA PGKGLEWVSY ISSSGGGTFY        60
ADSVKGRFTI SRDNSKNTLY LQMNSLRAED TAVYYCAKDR AYGDYVGWNG FDYWGQGTLV       120
TVSS                                                                    124

LC for Fab M274-G12

(SEQ ID NO: 510)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M274-G12

(SEQ ID NO: 511)
EVQLLESGGG LVQPGGSLRL SCAASGFTFS HYPMIWVRQA PGKGLEWVSY IYSSGGGTFY        60
ADSVKGRFTI SRDNSKNTLY LQMNSLRAED TAVYYCAKDR AYGDYVGWNG FDYWGQGTLV       120
TVSS                                                                    124

LC for Fab M274-F02

(SEQ ID NO: 512)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M274-F02

(SEQ ID NO: 513)
EVQLLESGGG LVQPGGSLRL SCAASGFTFS HYPMLWVRQA PGKGLEWVSY IYPSGGGTFY        60
ADSVKGRFTI SRDNSKNTLY LQMNSLRAED TAVYYCAKDR AYGDYVGWNG FDYWGQGTLV       120
TVSS                                                                    124

LC for Fab M276-H11

(SEQ ID NO: 514)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

-continued

HC for Fab M276-H11
(SEQ ID NO: 515)
```
EVQLLESGGG LVQPGGSLRL SCAASGFTFS HYPMMWVRQA PGKGLEWVSY ISSSGGYTGY    60
ADSVKGRFTI SRDNSKNTLY LQMNSLRAED TAVYYCAKDR AYGDYVGWNG FDYWGQGTLV   120
TVSS                                                               124
```

LC for Fab M303-C04
(SEQ ID NO: 516)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M303-C04
(SEQ ID NO: 517)
```
EVQLLESGGG LVQPGGSLRL SCAASGFTFS HYPMMWVRQA PGKGLEWVSY IYSSGGGTYY    60
ADSVKGRFTI SRDNSKNTLY LQMNSLRAED TAVYYCAKDR AYGDYVGWNG FDYWGQGTLV   120
TVSS                                                               124
```

LC for Fab M276-G09
(SEQ ID NO: 518)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M276-G09
(SEQ ID NO: 519)
```
EVQLLESGGG LVQPGGSLRL SCAASGFTFS HYPMVWVRQA PGKGLEWVSY ISPSGGYTGY    60
ADSVKGRFTI SRDNSKNTLY LQMNSLRAED TAVYYCAKDR AYGDYVGWNG FDYWGQGTLV   120
TVSS                                                               124
```

LC for Fab M298-D05
(SEQ ID NO: 520)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M298-D05
(SEQ ID NO: 521)
```
EVQLLESGGG LVQPGGSLRL SCAASGFTFS HYPMWWVRQA PGKGLEWVSS ISPSGGATFY    60
ADSVKGRFTI SRDNSKNTLY LQMNSLRAED TAVYYCAKDR AYGDYVGWNG FDYWGQGTLV   120
TVSS                                                               124
```

LC for Fab M305-G05
(SEQ ID NO: 522)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M305-G05
(SEQ ID NO: 523)
```
EVQLLESGGG LVQPGGSLRL SCAASGFTFS HYPMWWVRQA PGKGLEWVSV IYSSGGGTFY    60
ADSVKGRFTI SRDNSKNTLY LQMNSLRAED TAVYYCAKDR AYGDYVGWNG FDYWGQGTLV   120
TVSS                                                               124
```

LC for Fab M269-D03
(SEQ ID NO: 524)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M269-D03
(SEQ ID NO: 525)
```
EVQLLESGGG LVQPGGSLRL SCAASGFTFS HYPMWWVRQA PGKGLEWVSW IVPSGGFTLY    60
ADSVKGRFTI SRDNSKNTLY LQMNSLRAED TAVYYCAKDR AYGDYVGWNG FDYWGQGTLV   120
TVSS                                                               124
```

LC for Fab M275-A08
(SEQ ID NO: 526)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M275-A08
(SEQ ID NO: 527)
```
EVQLLESGGG LVQPGGSLRL SCAASGFTFS HYPMWWVRQA PGKGLEWVSY IHPSGGGTLY    60
ADSVKGRFTI SRDNSKNTLY LQMNSLRAED TAVYYCAKDR AYGDYVGWNG FDYWGQGTLV   120
TVSS                                                               124
```

LC for Fab M299-A12
(SEQ ID NO: 528)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

```
HC for Fab M299-A12
                                                   (SEQ ID NO: 529)
EVQLLESGGG LVQPGGSLRL SCAASGFTFS HYPMWWVRQA PGKGLEWVSY ISSSGGGTFY     60
ADSVKGRFTI SRDNSKNTLY LQMNSLRAED TAVYYCAKDR AYGDYVGWNG FDYWGQGTLV    120
TVSS                                                                124

LC for Fab M302-D10
                                                   (SEQ ID NO: 530)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M302-D10
                                                   (SEQ ID NO: 531)
EVQLLESGGG LVQPGGSLRL SCAASGFTFS HYPMWWVRQA PGKGLEWVSY IVPSGGATFY     60
ADSVKGRFTI SRDNSKNTLY LQMNSLRAED TAVYYCAKDR AYGDYVGWNG FDYWGQGTLV    120
TVSS                                                                124

LC for Fab M272-H12
                                                   (SEQ ID NO: 532)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M272-H12
                                                   (SEQ ID NO: 533)
EVQLLESGGG LVQPGGSLRL SCAASGFTFS HYPMWWVRQA PGKGLEWVSY IYPSGGGTYY     60
ADSVKGRFTI SRDNSKNTLY LQMNSLRAED TAVYYCAKDR AYGDYVGWNG FDYWGQGTLV    120
TVSS                                                                124

LC for Fab M304-G08
                                                   (SEQ ID NO: 534)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M304-G08
                                                   (SEQ ID NO: 535)
EVQLLESGGG LVQPGGSLRL SCAASGFTFS HYQMWWVRQA PGKGLEWVSS ISSSGGGTYY     60
ADSVKGRFTI SRDNSKNTLY LQMNSLRAED TAVYYCAKDR AYGDYVGWNG FDYWGQGTLV    120
TVSS                                                                124

LC for Fab M298-A01
                                                   (SEQ ID NO: 536)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M298-A01
                                                   (SEQ ID NO: 537)
EVQLLESGGG LVQPGGSLRL SCAASGFTFS HYSMMWVRQD PGKGLEWVSY ISPSGGYTGY     60
ADSVKGRFTI SRDNSKNTLY LQMNSLRAED TAVYYCAKDR AYGDYVGWNG FDYWGQGTLV    120
TVSS                                                                124

LC for Fab M272-E07
                                                   (SEQ ID NO: 538)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M272-E07
                                                   (SEQ ID NO: 539)
EVQLLESGGG LVQPGGSLRL SCAASGFTFS HYSMWWVRQA PGKGLEWVSV IYPSGGATFY     60
ADSVKGRFTI SRDNSKNTLY LQMNSLRAED TAVYYCAKDR AYGDYVGWNG FDYWGQGTLV    120
TVSS                                                                124

LC for Fab M268-F03
                                                   (SEQ ID NO: 540)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M268-F03
                                                   (SEQ ID NO: 541)
EVQLLESGGG LVQPGGSLRL SCAASGFTFS IYDMWWVRQA PGKGLEWVSV ISPSGGSTYY     60
ADSVKGRFTI SRDNSKNTLY LQMNSLRAED TAVYYCAKDR AYGDYVGWNG FDYWGQGTLV    120
TVSS                                                                124

LC for Fab M268-B08
                                                   (SEQ ID NO: 542)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108
```

-continued

HC for Fab M268-B08
(SEQ ID NO: 543)
```
EVQLLESGGG LVQPGGSLRL SCAASGFTFS IYDMWWVRQA PGKGLEWVSV IYPSGGATWY    60
ADSVKGRFTI SRDNSKNTLY LQMNSLRAED TAVYYCAKDR AYGDYVGWNG FDYWGQGTLV   120
TVSS                                                                124
```

LC for Fab M271-A03
(SEQ ID NO: 544)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M271-A03
(SEQ ID NO: 545)
```
EVQLLESGGG LVQPGGSLRL SCAASGFTFS IYDMWWVRQA PGKGLEWVSV IYPSGGPTFY    60
ADSVKGRFTI SRDNSKNTLY LQMNSLRAED TAVYYCAKDR AYGDYVGWNG FDYWGQGTLV   120
TVSS                                                                124
```

LC for Fab M270-G02
(SEQ ID NO: 546)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M270-G02
(SEQ ID NO: 547)
```
EVQLLESGGG LVQPGGSLRL SCAASGFTFS IYDMWWVRQA PGKGLEWVSV IYPSGGVTFY    60
ADSVKGRFTI SRDNSKNTLY LQMNSLRAED TAVYYCAKDR AYGDYVGWNG FDYWGQGTLV   120
TVSS                                                                124
```

LC for Fab M277-H05
(SEQ ID NO: 548)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M277-H05
(SEQ ID NO: 549)
```
EVQLLESGGG LVQPGGSLRL SCAASGFTFS IYDMWWVRQA PGKGLEWVSV IYSSGGFTGY    60
ADSVKGRFTI SRDNSKNTLY LQMNSLRAED TAVYYCAKDR AYGDYVGWNG FDYWGQGTLV   120
TVSS                                                                124
```

LC for Fab M273-F04
(SEQ ID NO: 550)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M273-F04
(SEQ ID NO: 551)
```
EVQLLESGGG LVQPGGSLRL SCAASGFTFS IYPMIWVRQA PGKGLEWVSY ISPSGGYTSY    60
ADSVKGRFTI SRDNSKNTLY LQMNSLRAED TAVYYCAKDR AYGDYVGWNG FDYWGQGTLV   120
TVSS                                                                124
```

LC for Fab M268-G10
(SEQ ID NO: 552)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M268-G10
(SEQ ID NO: 553)
```
EVQLLESGGG LVQPGGSLRL SCAASGFTFS IYPMWWVRQA PGKGLEWVSY ISPSGGFTSY    60
ADSVKGRFTI SRDNSKNTLY LQMNSLRAED TAVYYCAKDR AYGDYVGWNG FDYWGQGTLV   120
TVSS                                                                124
```

LC for Fab M300-F01
(SEQ ID NO: 554)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M300-F01
(SEQ ID NO: 555)
```
EVQLLESGGG LVQPGGSLRL SCAASGFTFS IYPMWWVRQA PGKGLEWVSY ISPSGGGTYY    60
ADSVKGRFTI SRDNSKNTLY LQMNSLRAED TAVYYCAKDR AYGDYVGWNG FDYWGQGTLV   120
TVSS                                                                124
```

LC for Fab M273-H03
(SEQ ID NO: 556)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

```
HC for Fab M273-H03
                                                    (SEQ ID NO: 557)
EVQLLESGGG LVQPGGSLRL SCAASGFTFS IYPMWWVRQA PGKGLEWVSY ISSSGGWTDY      60
ADSVKGRFTI SRDNSKNTLY LQMNSLRAED TAVYYCAKDR AYGDYVGWNG FDYWGQGTLV     120
TVSS                                                                  124

LC for Fab M277-C11
                                                    (SEQ ID NO: 558)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M277-C11
                                                    (SEQ ID NO: 559)
EVQLLESGGG LVQPGGSLRL SCAASGFTFS IYPMWWVRQA PGKGLEWVSY IVPSGGMTYY      60
ADSVKGRFTI SRDNSKNTLY LQMNSLRAED TAVYYCAKDR AYGDYVGWNG FDYWGQGTLV     120
TVSS                                                                  124

LC for Fab M273-G06
                                                    (SEQ ID NO: 560)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M273-G06
                                                    (SEQ ID NO: 561)
EVQLLESGGG LVQPGGSLRL SCAASGFTFS IYPMWWVRQA PGKGLEWVSY IYPSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M273-B10
                                                    (SEQ ID NO: 562)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M273-B10
                                                    (SEQ ID NO: 563)
EVQLLESGGG LVQPGGSLRL SCAASGFTFS KYAMIWVRQA PGKGLEWVSW IPPSGGYTSY      60
ADSVKGRFTI SRDNSKNTLY LQMNSLRAED TAVYYCAKDR AYGDYVGWNG FDYWGQGTLV     120
TVSS                                                                  124

LC for Fab M272-F08
                                                    (SEQ ID NO: 564)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M272-F08
                                                    (SEQ ID NO: 565)
EVQLLESGGG LVQPGGSLRL SCAASGFTFS KYAMIWVRQA PGKGLEWVSY ISPSGGFTGY      60
ADSVKGRFTI SRDNSKNTLY LQMNSLRAED TAVYYCAKDR AYGDYVGWNG FDYWGQGTLV     120
TVSS                                                                  124

LC for Fab M270-G12
                                                    (SEQ ID NO: 566)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M270-G12
                                                    (SEQ ID NO: 567)
EVQLLESGGG LVQPGGSLRL SCAASGFTFS KYAMIWVRQS PGKGLEWVSY ISSSGGFTDY      60
ADSVKGRFTI SRDNSKNTLY LQMNSLRAED TAVYYCAKDR AYGDYVGWNG FDYWGQGTLV     120
TVSS                                                                  124

LC for Fab M274-H05
                                                    (SEQ ID NO: 568)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M274-H05
                                                    (SEQ ID NO: 569)
EVQLLESGGG LVQPGGSLRL SCAASGFTFS KYAMWWVRQA PGKGLEWVSS ISPSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M271-F05
                                                    (SEQ ID NO: 570)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M271-F05

(SEQ ID NO: 571)
EVQLLESGGG LVQPGGSLRL SCAASGFTFS KYAMWWVRQA PGKGLEWVSY IVPSGGRTFY    60
ADSVKGRFTI SRDNSKNTLY LQMNSLRAED TAVYYCAKDR AYGDYVGWNG FDYWGQGTLV   120
TVSS                                                                124

LC for Fab M273-H08

(SEQ ID NO: 572)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M273-H08

(SEQ ID NO: 573)
EVQLLESGGG LVQPGGSLRL SCAASGFTFS KYDMFWVRQA PGKGLEWVSS IVPSGGATYY    60
ADSVKGRFTI SRDNSKNTLY LQMNSLRAED TAVYYCAKDR AYGDYVGWNG FDYWGQGTLV   120
TVSS                                                                124

LC for Fab M271-H02

(SEQ ID NO: 574)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-H02

(SEQ ID NO: 575)
EVQLLESGGG LVQPGGSLRL SCAASGFTFS KYDMIWVRQA PGKGLEWVSW IGPSGGATMY    60
ADSVKGRFTI SRDNSKNTLY LQMNSLRAED TAVYYCAKDR AYGDYVGWNG FDYWGQGTLV   120
TVSS                                                                124

LC for Fab M306-A12

(SEQ ID NO: 576)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M306-A12

(SEQ ID NO: 577)
EVQLLESGGG LVQPGGSLRL SCAASGFTFS KYDMIWVRQA PGKGLEWVSY IGSSGGYTGY    60
ADSVKGRFTI SRDNSKNTLY LQMNSLRAED TAVYYCAKDR AYGDYVGWNG FDYWGQGTLV   120
TVSS                                                                124

LC for Fab M271-B06

(SEQ ID NO: 578)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-B06

(SEQ ID NO: 579)
EVQLLESGGG LVQPGGSLRL SCAASGFTFS KYDMWWVRQA PGKGLEWVSS ISSSGGGTFY    60
ADSVKGRFTI SRDNSKNTLY LQMNSLRAED TAVYYCAKDR AYGDYVGWNG FDYWGQGTLV   120
TVSS                                                                124

LC for Fab M271-D01

(SEQ ID NO: 580)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-D01

(SEQ ID NO: 581)
EVQLLESGGG LVQPGGSLRL SCAASGFTFS KYDMWWVRQA PGKGLEWVSV IYPSGGPTFY    60
ADSVKGRFTI SRDNSKNTLY LQMNSLRAED TAVYYCAKDR AYGDYVGWNG FDYWGQGTLV   120
TVSS                                                                124

LC for Fab M269-H03

(SEQ ID NO: 582)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M269-H03

(SEQ ID NO: 583)
EVQLLESGGG LVQPGGSLRL SCAASGFTFS KYDMWWVRQA PGKGLEWVSV IYPSGGQTYY    60
ADSVKGRFTI SRDNSKNTLY LQMNSLRAED TAVYYCAKDR AYGDYVGWNG FDYWGQGTLV   120
TVSS                                                                124

LC for Fab M274-E01

(SEQ ID NO: 584)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

```
HC for Fab M274-E01
                                                           (SEQ ID NO: 585)
EVQLLESGGG LVQPGGSLRL SCAASGFTFS KYDMWWVRQA PGKGLEWVSV IYPSGGSTYY          60
ADSVKGRFTI SRDNSKNTLY LQMNSLRAED TAVYYCAKDR AYGDYVGWNG FDYWGQGTLV         120
TVSS                                                                     124

LC for Fab M275-B12
                                                           (SEQ ID NO: 586)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                     108

HC for Fab M275-B12
                                                           (SEQ ID NO: 587)
EVQLLESGGG LVQPGGSLRL SCAASGFTFS KYDMWWVRQA PGKGLEWVSV IYSSGGFTLY          60
ADSVKGRFTI SRDNSKNTLY LQMNSLRAED TAVYYCAKDR AYGDYVGWNG FDYWGQGTLV         120
TVSS                                                                     124

LC for Fab M270-H06
                                                           (SEQ ID NO: 588)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                     108

HC for Fab M270-H06
                                                           (SEQ ID NO: 589)
EVQLLESGGG LVQPGGSLRL SCAASGFTFS KYDMWWVRQA PGKGLEWVSV IYSSGGFTSY          60
ADSVKGRFTI SRDNSKNTLY LQMNSLRAED TAVYYCAKDR AYGDYVGWNG FDYWGQGTLV         120
TVSS                                                                     124

LC for Fab M271-A04
                                                           (SEQ ID NO: 590)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                     108

HC for Fab M271-A04
                                                           (SEQ ID NO: 591)
EVQLLESGGG LVQPGGSLRL SCAASGFTFS KYDMWWVRQA PGKGLEWVSV IYSSGGPTFY          60
ADSVKGRFTI SRDNSKNTLY LQMNSLRAED TAVYYCAKDR AYGDYVGWNG FDYWGQGTLV         120
TVSS                                                                     124

LC for Fab M272-C09
                                                           (SEQ ID NO: 592)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                     108

HC for Fab M272-C09
                                                           (SEQ ID NO: 593)
EVQLLESGGG LVQPGGSLRL SCAASGFTFS KYDMWWVRQA PGKGLEWVSY IGPSGGFTDY          60
ADSVKGRFTI SRDNSKNTLY LQMNSLRAED TAVYYCAKDR AYGDYVGWNG FDYWGQGTLV         120
TVSS                                                                     124

LC for Fab M274-G09
                                                           (SEQ ID NO: 594)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                     108

HC for Fab M274-G09
                                                           (SEQ ID NO: 595)
EVQLLESGGG LVQPGGSLRL SCAASGFTFS KYDMWWVRQA PGKGLEWVSY ISSSGGFTDY          60
ADSVKGRFTI SRDNSKNTLY LQMNSLRAED TAVYYCAKDR AYGDYVGWNG FDYWGQGTLV         120
TVSS                                                                     124

LC for Fab M299-F05
                                                           (SEQ ID NO: 596)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                     108

HC for Fab M299-F05
                                                           (SEQ ID NO: 597)
EVQLLESGGG LVQPGGSLRL SCAASGFTFS KYDMWWVRQA PGKGLEWVSY IVPSGGFIDY          60
ADSVKGRFTI SRDNSKNTLY LQMNSLRAED TAVYYCAKDR AYGDYVGWNG FDYWGQGTLV         120
TVSS                                                                     124

LC for Fab M275-B05
                                                           (SEQ ID NO: 598)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                     108
```

```
HC for Fab M275-B05
                                                      (SEQ ID NO: 599)
EVQLLESGGG LVQPGGSLRL SCAASGFTFS KYEMFWVRQA PGKGLEWVSS ISSSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M271-H04
                                                      (SEQ ID NO: 600)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M271-H04
                                                      (SEQ ID NO: 601)
EVQLLESGGG LVQPGGSLRL SCAASGFTFS KYEMWWVRQA PGKGLEWVSV IYPSGGMTYY      60
ADSVKGRFTI SRDNSKNTLY LQMNSLRAED TAVYYCAKDR AYGDYVGWNG FDYWGQGTLV     120
TVSS                                                                  124

LC for Fab M277-D11
                                                      (SEQ ID NO: 602)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M277-D11
                                                      (SEQ ID NO: 603)
EVQLLESGGG LVQPGGSLRL SCAASGFTFS KYEMWWVRQA PGKGLEWVSV IYPSGGYTGY      60
ADSVKGRFTI SRDNSKNTLY LQMNSLRAED TAVYYCAKDR AYGDYVGWNG FDYWGQGTLV     120
TVSS                                                                  124

LC for Fab M268-B02
                                                      (SEQ ID NO: 604)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M268-B02
                                                      (SEQ ID NO: 605)
EVQLLESGGG LVQPGGSLRL SCAASGFTFS KYEMWWVRQA PGKGLEWVSV IYSSGGKTYY      60
ADSVKGRFTI SRDNSKNTLY LQMNSLRAED TAVYYCAKDR AYGDYVGWNG FDYWGQGTLV     120
TVSS                                                                  124

LC for Fab M275-E04
                                                      (SEQ ID NO: 606)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M275-E04
                                                      (SEQ ID NO: 607)
EVQLLESGGG LVQPGGSLRL SCAASGFTFS KYEMWWVRQA PGKGLEWVSY IGPSGGFTDY      60
ADSVKGRFTI SRDNSKNTLY LQMNSLRAED TAVYYCAKDR AYGDYVGWNG FDYWGQGTLV     120
TVSS                                                                  124

LC for Fab M275-D12
                                                      (SEQ ID NO: 608)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M275-D12
                                                      (SEQ ID NO: 609)
EVQLLESGGG LVQPGGSLRL SCAASGFTFS KYEMWWVRQA PGKGLEWVSY IGPSGGITMY      60
ADSVKGRFTI SRDNSKNTLY LQMNSLRAED TAVYYCAKDR AYGDYVGWNG FDYWGQGTLV     120
TVSS                                                                  124

LC for Fab M270-A02
                                                      (SEQ ID NO: 610)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M270-A02
                                                      (SEQ ID NO: 611)
EVQLLESGGG LVQPGGSLRL SCAASGFTFS KYEMWWVRQA PGKGLEWVSY ISPSGGGTLY      60
ADSVKGRFTI SRDNSKNTLY LQMNSLRAED TAVYYCAKDR AYGDYVGWNG FDYWGQGTLV     120
TVSS                                                                  124

LC for Fab M277-F09
                                                      (SEQ ID NO: 612)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

-continued

HC for Fab M277-F09

(SEQ ID NO: 613)
EVQLLESGGG LVQPGGSLRL SCAASGFTFS KYMMFWVRQA PGKGLEWVSS IYSSGGRTFY   60
ADSVKGRFTI SRDNSKNTLY LQMNSLRAED TAVYYCAKDR AYGDYVGNG FDYWGQGTLV  120
TVSS                                                             124

LC for Fab M269-G12

(SEQ ID NO: 614)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M269-G12

(SEQ ID NO: 615)
EVQLLESGGG LVQPGGSLRL SCAASGFTFS KYNMWWVRQA PGKGLEWVSS IYPSGGATFY   60
ADSVKGRFTI SRDNSKNTLY LQMNSLRAED TAVYYCAKDR AYGDYVGWNG FDYWGQGTLV  120
TVSS                                                             124

LC for Fab M273-G04

(SEQ ID NO: 616)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M273-G04

(SEQ ID NO: 617)
EVQLLESGGG LVQPGGSLRL SCAASGFTFS KYNMWWVRQA PGKGLEWVSV IYPSGGATFY   60
ADSVKGRFTI SRDNSKNTLY LQMNSLRAED TAVYYCAKDR AYGDYVGWNG FDYWGQGTLV  120
TVSS                                                             124

LC for Fab M269-G04

(SEQ ID NO: 618)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M269-G04

(SEQ ID NO: 619)
EVQLLESGGG LVQPGGSLRL SCAASGFTFS KYPMFWVRQA PGKGLEWVSY IVPSGGYTSY   60
ADSVKGRFTI SRDNSKNTLY LQMNSLRAED TAVYYCAKDR AYGDYVGWNG FDYWGQGTLV  120
TVSS                                                             124

LC for Fab M269-B01

(SEQ ID NO: 620)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M268-B01

(SEQ ID NO: 621)
EVQLLESGGG LVQPGGSLRL SCAASGFTFS KYPMIWVRQA PGKGLEWVSY ISPSGGYTGY   60
ADSVKGRFTI SRDNSKNTLY LQMNSLRAED TAVYYCAKDR AYGDYVGWNG FDYWGQGTLV  120
TVSS                                                             124

LC for Fab M268-B06

(SEQ ID NO: 622)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M268-B06

(SEQ ID NO: 623)
EVQLLESGGG LVQPGGSLRL SCAASGFTFS KYPMIWVRQA PGKGLEWVSY ISPSGGYTSY   60
ADSVKGRFTI SRDNSKNTLY LQMNSLRAED TAVYYCAKDR AYGDYVGWNG FDYWGQGTLV  120
TVSS                                                             124

LC for Fab M272-A11

(SEQ ID NO: 624)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M272-A11

(SEQ ID NO: 625)
EVQLLESGGG LVQPGGSLRL SCAASGFTFS KYPMIWVRQA PGKGLEWVSY ISSSGGWTDY   60
ADSVKGRFTI SRDNSKNTLY LQMNSLRAED TAVYYCAKDR AYGDYVGWNG FDYWGQGTLV  120
TVSS                                                             124

LC for Fab M274-H02

(SEQ ID NO: 626)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M274-H02

(SEQ ID NO: 627)
EVQLLESGGG LVQPGGSLRL SCAASGFTFS KYPMIWVRQA PGKGLEWVSY IYPSGGATYY          60
ADSVKGRFTI SRDNSKNTLY LQMNSLRAED TAVYYCAKDR AYGDYVGWNG FDYWGQGTLV         120
TVSS                                                                     124

LC for Fab M275-C12

(SEQ ID NO: 628)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                      108

HC for Fab M275-C12

(SEQ ID NO: 629)
EVQLLESGGG LVQPGGSLRL SCAASGFTFS KYPMIWVRQA PGKGLEWVSY IYPSGGYTSY          60
ADSVKGRFTI SRDNSKNTLY LQMNSLRAED TAVYYCAKDR AYGDYVGWNG FDYWGQGTLV         120
TVSS                                                                     124

LC for Fab M268-G12

(SEQ ID NO: 630)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                      108

HC for Fab M268-G12

(SEQ ID NO: 631)
EVQLLESGGG LVQPGGSLRL SCAASGFTFS KYPMIWVRQA PGKGLEWVSY IYSSGGGTYY          60
ADSVKGRFTI SRDNSKNTLY LQMNSLRAED TAVYYCAKDR AYGDYVGWNG FDYWGQGTLV         120
TVSS                                                                     124

LC for Fab M271-C02

(SEQ ID NO: 632)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                      108

HC for Fab M271-C02

(SEQ ID NO: 633)
EVQLLESGGG LVQPGGSLRL SCAASGFTFS KYPMMWVRQA PGKGLEWVSY ISPSGGFTDY          60
ADSVKGRFTI SRDNSKNTLY LQMNSLRAED TAVYYCAKDR AYGDYVGWNG FDYWGQGTLV         120
TVSS                                                                     124

LC for Fab M268-E09

(SEQ ID NO: 634)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                      108

HC for Fab M268-E09

(SEQ ID NO: 635)
EVQLLESGGG LVQPGGSLRL SCAASGFTFS KYPMMWVRQA PGKGLEWVSY IYPSGGYTDY          60
ADSVKGRFTI SRDNSKNTLY LQMNSLRAED TAVYYCAKDR AYGDYVGWNG FDYWGQGTLV         120
TVSS                                                                     124

LC for Fab M274-F09

(SEQ ID NO: 636)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                      108

HC for Fab M274-F09

(SEQ ID NO: 637)
EVQLLESGGG LVQPGGSLRL SCAASGFTFS KYPMMWVRQA PGKGLEWVSY IYPSGGYTGY          60
ADSVKGRFTI SRDNSKNTLY LQMNSLRAED TAVYYCAKDR AYGDYVGWNG FDYWGQGTLV         120
TVSS                                                                     124

LC for Fab M271-F02

(SEQ ID NO: 638)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                      108

HC for Fab M271-F02

(SEQ ID NO: 639)
EVQLLESGGG LVQPGGSLRL SCAASGFTFS KYPMWWVRQA PGKGLEWVSS IVSSGGATYY          60
TDSVKGRFTI SRDNSKNTLY LQMNSLRAED TAVYYCAKDR AYGDYVGWNG FDYWGQGTLV         120
TVSS                                                                     124

LC for Fab M276-B12

(SEQ ID NO: 640)
QDIQMTQSPA TLSLSPGERA TLSCRASQSI SSFLAWYQQK PGQAPRLLIY DASYRATGIP          60
ARFSGSGSGT DFTLTISSLE PEDYAVYYCQ QRGNWPITFG QGTRLEIK                      108

-continued

HC for Fab M276-B12
(SEQ ID NO: 641)
```
EVQLLESGGG LVQPGGSLRL SCAASGFTFS KYPMWWVRQA PGKGLEWVSS IYPSGGYTGY    60
ADSVKGRFTI SRDNSKNTLY LQMNSLRAED TAVYYCAKDR AYGDYVGWNG FDYWGQGTLV   120
TVSS                                                               124
```

LC for Fab M272-H09
(SEQ ID NO: 642)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M272-H09
(SEQ ID NO: 643)
```
EVQLLESGGG LVQPGGSLRL SCAASGFTFS KYPMWWVRQA PGKGLEWVSV ISPSGGATYY    60
ADSVKGRFTI SRDNSKNTLY LQMNSLRAED TAVYYCAKDR AYGDYVGWNG FDYWGQGTLV   120
TVSS                                                               124
```

LC for Fab M272-G02
(SEQ ID NO: 644)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M272-G02
(SEQ ID NO: 645)
```
EVQLLESGGG LVQPGGSLRL SCAASGFTFS KYPMWWVRQA PGKGLEWVSV IYPSGGYTAY    60
ADSVKGRFTI SRDNSKNTLY LQMNSLRAED TAVYYCAKDR AYGDYVGWNG FDYWGQGTLV   120
TVSS                                                               124
```

LC for Fab M274-E04
(SEQ ID NO: 646)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M274-E04
(SEQ ID NO: 647)
```
EVQLLESGGG LVQPGGSLRL SCAASGFTFS KYPMWWVRQA PGKGLEWVSV IYSSGGGTFY    60
ADSVKGRFTI SRDNSKNTLY LQMNSLRAED TAVYYCAKDR AYGDYVGWNG FDYWGQGTLV   120
TVSS                                                               124
```

LC for Fab M303-B07
(SEQ ID NO: 648)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M303-B07
(SEQ ID NO: 649)
```
EVQLLESGGG LVQPGGSLRL SCAASGFTFS KYPMWWVRQA PGKGLEWVSY ISPSGGGTLY    60
ADSVKGRFTI SRDNSKNTLY LQMNSLRAED TAVYYCAKDR AYGDYVGWNG FDYWGQGTLV   120
TVSS                                                               124
```

LC for Fab M275-D06
(SEQ ID NO: 650)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M275-D06
(SEQ ID NO: 651)
```
EVQLLESGGG LVQPGGSLRL SCAASGFTFS KYPMWWVRQA PGKGLEWVSY ISPSGGGTYY    60
ADSVKGRFTI SRDNSKNTLY LQMNSLRAED TAVYYCAKDR AYGDYVGWNG FDYWGQGTLV 120   120
TVSS                                                               124
```

LC for Fab M271-D04
(SEQ ID NO: 652)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M271-D04
(SEQ ID NO: 653)
```
EVQLLESGGG LVQPGGSLRL SCAASGFTFS KYPMWWVRQA PGKGLEWVSY ISSSGGGTYY    60
ADSVKGRFTI SRDNSKNTLY LQMNSLRAED TAVYYCAKDR AYGDYVGWNG FDYWGQGTLV   120
TVSS                                                               124
```

LC for Fab M268-H03
(SEQ ID NO: 654)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M268-H03
(SEQ ID NO: 655)
EVQLLESGGG LVQPGGSLRL SCAASGFTFS KYPMWWVRQA PGKGLEWVSY IVPSGGATFY   60
ADSVKGRFTI SRDNSKNTLY LQMNSLRAED TAVYYCAKDR AYGDYVGWNG FDYWGQGTLV  120
TVSS                                                              124

LC for Fab M272-A03
(SEQ ID NO: 656)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M274-A03
(SEQ ID NO: 657)
EVQLLESGGG LVQPGGSLRL SCAASGFTFS KYPMWWVRQA PGKGLEWVSY IVPSGGPTWY   60
ADSVKGRFTI SRDNSKNTLY LQMNSLRAED TAVYYCAKDR AYGDYVGWNG FDYWGQGTLV  120
TVSS                                                              124

LC for Fab M274-G07
(SEQ ID NO: 658)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M274-G07
(SEQ ID NO: 659)
EVQLLESGGG LVQPGGSLRL SCAASGFTFS KYPMWWVRQA PGKGLEWVSY IVPSGGWTAY   60
ADSVKGRFTI SRDNSKNTLY LQMNSLRAED TAVYYCAKDR AYGDYVGWNG FDYWGQGTLV  120
TVSS                                                              124

LC for Fab M270-E01
(SEQ ID NO: 660)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M270-E01
(SEQ ID NO: 661)
EVQLLESGGG LVQPGGSLRL SCAASGFTFS KYQMWWVRQA PGKGLEWVSS IYPSGGATFY   60
ADSVKGRFTI SRDNSKNTLY LQMNSLRAED TAVYYCAKDR AYGDYVGWNG FDYWGQGTLV  120
TVSS                                                              124

LC for Fab M270-G09
(SEQ ID NO: 662)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M270-G09
(SEQ ID NO: 663)
EVQLLESGGG LVQPGGSLRL SCAASGFTFS KYQMWWVRQA PGKGLEWVSS IYPSGGGTFY   60
ADSVKGRFTI SRDNSKNTLY LQMNSLRAED TAVYYCAKDR AYGDYVGWNG FDYWGQGTLV  120
TVSS                                                              124

LC for Fab M272-B11
(SEQ ID NO: 664)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M272-B11
(SEQ ID NO: 665)
EVQLLESGGG LVQPGGSLRL SCAASGFTFS KYSMIWVRQA PGKGLEWVSY IVPSGGYTGY   60
ADSVKGRFTI SRDNSKNTLY LQMNSLRAED TAVYYCAKDR AYGDYVGWNG FDYWGQGTLV  120
TVSS                                                              124

LC for Fab M268-C03
(SEQ ID NO: 666)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M268-C03
(SEQ ID NO: 667)
EVQLLESGGG LVQPGGSLRL SCAASGFTFS KYSMWWVRQA PGKGLEWVSS IYPSGGATFY   60
ADSVKGRFTI SRDNSKNTLY LQMNSLRAED TAVYYCAKDR AYGDYVGWNG FDYWGQGTLV  120
TVSS                                                              124

LC for Fab M270-E10
(SEQ ID NO: 668)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

```
HC for Fab M270-E10
                                                         (SEQ ID NO: 669)
EVQLLESGGG LVQPGGSLRL SCAASGFTFS KYSMWWVRQA PGKGLEWVSV IYPSGGATFY      60
ADSVKGRFTI SRDNSKNTLY LQMNSLRAED TAVYYCAKDR AYGDYVGWNG FDYWGQGTLV     120
TVSS                                                                 124

LC for Fab M305-F06
                                                         (SEQ ID NO: 670)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M305-F06
                                                         (SEQ ID NO: 671)
EVQLLESGGG LVQPGGSLRL SCAASGFTFS KYSMWWVRQA PGKGLEWVSV IYPSGGFTDY      60
ADSVKGRFTI SRDNSKNTLY LQMNSLRAED TAVYYCAKDR AYGDYVGWNG FDYWGQGTLV     120
TVSS                                                                 124

LC for Fab M270-H04
                                                         (SEQ ID NO: 672)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M270-H04
                                                         (SEQ ID NO: 673)
EVQLLESGGG LVQPGGSLRL SCAASGFTFS KYLMWWVRQA PGKGLEWVSV IYPSGGATFY      60
ADSVKGRFTI SRDNSKNTLY LQMNSLRAED TAVYYCAKDR AYGDYVGWNG FDYWGQGTLV     120
TVSS                                                                 124

LC for Fab M269-D05
                                                         (SEQ ID NO: 674)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M269-D05
                                                         (SEQ ID NO: 675)
EVQLLESGGG LVQPGGSLRL SCAASGFTFS KYWMWWVRQA PGKGLEWVSV IVPSGGMTYY      60
ADSVKGRFTI SRDNSKNTLY LQMNSLRAED TAVYYCAKDR AYGDYVGWNG FDYWGQGTLV     120
TVSS                                                                 124

LC for Fab M270-F02
                                                         (SEQ ID NO: 676)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M270-F02
                                                         (SEQ ID NO: 677)
EVQLLESGGG LVQPGGSLRL SCAASGFTFS KYYMWWVRQA PGKGLEWVSS IYSSGGGTFY      60
ADSVKGRFTI SRDNSKNTLY LQMNSLRAED TAVYYCAKDR AYGDYVGWNG FDYWGQGTLV     120
TVSS                                                                 124

LC for Fab M275-D07
                                                         (SEQ ID NO: 678)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M275-D07
                                                         (SEQ ID NO: 679)
EVQLLESGGG LVQPGGSLRL SCAASGFTFS LYAMIWVRQA PGKGLEWVSY ISPSGGFTGY      60
ADSVKGRFTI SRDNSKNTLY LQMNSLRAED TAVYYCAKDR AYGDYVGWNG FDYWGQGTLV     120
TVSS                                                                 124

LC for Fab M273-E12
                                                         (SEQ ID NO: 680)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M273-E12
                                                         (SEQ ID NO: 681)
EVQLLESGGG LVQPGGSLRL SCAASGFTFS LYAMWWVRQA PGKGLEWVSS IVPSGGKTYY      60
ADSVKGRFTI SRDNSKNTLY LQMNSLRAED TAVYYCAKDR AYGDYVGWNG FDYWGQGTLV     120
TVSS                                                                 124

LC for Fab M273-A09
                                                         (SEQ ID NO: 682)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

-continued

HC for Fab M273-A09
(SEQ ID NO: 683)
```
EVQLLESGGG LVQPGGSLRL SCAASGFTFS LYAMWWVRQA PGKGLEWVSY IYPSGGGTYY     60
ADSVKGRFTI SRDNSKNTLY LQMNSLRAED TAVYYCAKDR AYGDYVGWNG FDYWGQGTLV   120
TVSS                                                                124
```

LC for Fab M271-G03
(SEQ ID NO: 684)
```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M271-G03
(SEQ ID NO: 685)
```
EVQLLESGGG LVQPGGSLRL SCAASGFTFS LYDMLWVRQA PGKGLEWVSY IYPSGGFTGY     60
ADSVKGRFTI SRDNSKNTLY LQMNSLRAED TAVYYCAKDR AYGDYVGWNG FDYWGQGTLV   120
TVSS                                                                124
```

LC for Fab M299-F01
(SEQ ID NO: 686)
```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M299-F01
(SEQ ID NO: 687)
```
EVQLLESGGG LVQPGGSLRL SCAASGFTFS LYDMVWVRQA PGKGLEWVSW IGPSGGLTIY     60
ADSVKGRFTI SRDNSKNTLY LQMNSLRAED TAVYYCAKDR AYGDYVGWNG FDYWGQGTLV   120
TVSS                                                                124
```

LC for Fab M274-A03
(SEQ ID NO: 688)
```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M274-A03
(SEQ ID NO: 689)
```
EVQLLESGGG LVQPGGSLRL SCAASGFTFS LYDMWWVRQA PGKGLEWVSS ISSSGGYTGY     60
ADSVKGRFTI SRDNSKNTLY LQMNSLRAED TAVYYCAKDR AYGDYVGWNG FDYWGQGTLV   120
TVSS                                                                124
```

LC for Fab M276-B04
(SEQ ID NO: 690)
```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M276-B04
(SEQ ID NO: 691)
```
EVQLLESGGG LVQPGGSLRL SCAASGFTFS LYDMWWVRQA PGKGLEWVSV IRPSGGSTYY     60
ADSVKGRFTI SRDNSKNTLY LQMNSLRAED TAVYYCAKDR AYGDYVGWNG FDYWGQGTLV   120
TVSS                                                                124
```

LC for Fab M269-B10
(SEQ ID NO: 692)
```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M269-B10
(SEQ ID NO: 693)
```
EVQLLESGGG LVQPGGSLRL SCAASGFTFS LYDMWWVRQA PGKGLEWVSV IYPSGGPTYY     60
ADSVKGRFTI SRDNSKNTLY LQMNSLRAED TAVYYCAKDR AYGDYVGWNG FDYWGQGTLV   120
TVSS                                                                124
```

LC for Fab M270-A05
(SEQ ID NO: 694)
```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M270-A05
(SEQ ID NO: 695)
```
EVQLLESGGG LVQPGGSLRL SCAASGFTFS LYDMWWVRQA PGKGLEWVSV IYSSGGATFY     60
ADSVKGRFTI SRDNSKNTLY LQMNSLRAED TAVYYCAKDR AYGDYVGWNG FDYWGQGTLV   120
TVSS                                                                124
```

LC for Fab M268-B11
(SEQ ID NO: 696)
```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

-continued

HC for Fab M268-B11

(SEQ ID NO: 697)
```
EVQLLESGGG LVQPGGSLRL SCAASGFTFS LYDMWWVRQA PGKGLEWVSV IYSSGGTTFY     60
ADSVKGRFTI SRDNSKNTLY LQMNSLRAED TAVYYCAKDR AYGDYVGWNG FDYWGQGTLV   120
TVSS                                                                124
```

LC for Fab M272-F10

(SEQ ID NO: 698)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M272-F10

(SEQ ID NO: 699)
```
EVQLLESGGG LVQPGGSLRL SCAASGFTFS LYDMWWVRQA PGKGLEWVSV IYSSGGYTAY    60
ADSVKGRFTI SRDNSKNTLY LQMNSLRAED TAVYYCAKDR AYGDYVGWNG FDYWGQGTLV   120
TVSS                                                                124
```

LC for Fab M307-F04

(SEQ ID NO: 700)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M307-F04

(SEQ ID NO: 701)
```
EVQLLESGGG LVQPGGSLRL SCAASGFTFS LYDMWWVRQA PGKGLEWVSV IYSSGGYTGY    60
ADSVKGRFTI SRDNSKNTLY LQMNSLRAED TAVYYCAKDR AYGDYVGWNG FDYWGQGTLV   120
TVSS                                                                124
```

LC for Fab M274-F08

(SEQ ID NO: 702)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M274-F08

(SEQ ID NO: 703)
```
EVQLLESGGG LVQPGGSLRL SCAASGFTFS LYDMWWVRQA PGKGLEWVSY IGPSGGNTLY    60
ADSVKGRFTI SRDNSKNTLY LQMNSLRAED TAVYYCAKDR AYGDYVGWNG FDYWGQGTLV   120
TVSS                                                                124
```

LC for Fab M275-D11

(SEQ ID NO: 704)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M275-D11

(SEQ ID NO: 705)
```
EVQLLESGGG LVQPGGSLRL SCAASGFTFS LYEMWWVRQA PGKGLEWVSV ISPSGGGTYY    60
ADSVKGRFTI SRDNSKNTLY LQMNSLRAED TAVYYCAKDR AYGDYVGWNG FDYWGQGTLV   120
TVSS                                                                124
```

LC for Fab M269-B03

(SEQ ID NO: 706)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M269-B03

(SEQ ID NO: 707)
```
EVQLLESGGG LVQPGGSLRL SCAASGFTFS LYEMWWVRQA PGKGLEWVSY ISSSGGGTLY    60
ADSVKGRFTI SRDNSKNTLY LQMNSLRAED TAVYYCAKDR AYGDYVGWNG FDYWGQGTLV   120
TVSS                                                                124
```

LC for Fab M269-F10

(SEQ ID NO: 708)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M269-F10

(SEQ ID NO: 709)
```
EVQLLESGGG LVQPGGSLRL SCAASGFTFS LYMMWWVRKA PGKGLEWVSS IYPSGGTYYA    60
DSVKGRFTIS RDNSKNTLYL QMNSLRAEDT AVYYCAKDRA YGDYVGWNGF DYWGQGTLVT   120
VSS                                                                 123
```

LC for Fab M306-E11

(SEQ ID NO: 710)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

```
HC for Fab M306-E11
                                                     (SEQ ID NO: 711)
EVQLLESGGG LVQPGGSLRL SCAASGFTFS LYNMWWVRQA PGKGLEWVSV IYPSGGYTGY      60
ADSVKGRFTI SRDNSKNTLY LQMNSLRAED TAVYYCAKDR AYGDYVGWNG FDYWGQGTLV     120
TVSS                                                                  124

LC for Fab M271-B12
                                                     (SEQ ID NO: 712)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M271-B12
                                                     (SEQ ID NO: 713)
EVQLLESGGG LVQPGGSLRL SCAASGFTFS LYPMIWVRQA PGKGLEWVSY ISPSGGFTDY      60
ADSVKGRFTI SRDNSKNTLY LQMNSLRAED TAVYYCAKDR AYGDYVGWNG FDYWGQGTLV     120
TVSS                                                                  124

LC for Fab M304-E07
                                                     (SEQ ID NO: 714)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M304-E07
                                                     (SEQ ID NO: 715)
EVQLLESGGG LVQPGGSLRL SCAASGFTFS LYPMMWVRQA PGKGLEWVSY IYPSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M268-H02
                                                     (SEQ ID NO: 716)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M268-H02
                                                     (SEQ ID NO: 717)
EVQLLESGGG LVQPGGSLRL SCAASGFTFS LYPMWWVRQA PGKGLEWVSS ISPSGGATFY      60
ADSVKGRFTI SRDNSKNTLY LQMNSLRAED TAVYYCAKDR AYGDYVGWNG FDYWGQGTLV     120
TVSS                                                                  124

LC for Fab M301-B03
                                                     (SEQ ID NO: 718)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M301-B03
                                                     (SEQ ID NO: 719)
EVQLLESGGG LVQPGGSLRL SCAASGFTFS LYPMWWVRQA PGKGLEWVSS ISPSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M306-D04
                                                     (SEQ ID NO: 720)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M306-D04
                                                     (SEQ ID NO: 721)
EVQLLESGGG LVQPGGSLRL SCAASGFTFS LYPMWWVRQA PGKGLEWVSS IYPSGGATFY      60
ADSVKGRFTI SRDNSKNTLY LQMNSLRAED TAVYYCAKDR AYGDYVGWNG FDYWGQGTLV     120
TVSS                                                                  124

LC for Fab M270-D05
                                                     (SEQ ID NO: 722)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M270-D05
                                                     (SEQ ID NO: 723)
EVQLLESGGG LVQPGGSLRL SCAASGFTFS LYPMWWVRQA PGKGLEWVSV IYSSGGATFY      60
ADSVKGRFTI SRDNSKNTLY LQMNSLRAED TAVYYCAKDR AYGDYVGWNG FDYWGQGTLV     120
TVSS                                                                  124

LC for Fab M269-C07
                                                     (SEQ ID NO: 724)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

-continued

HC for Fab M269-C07

(SEQ ID NO: 725)
EVQLLESGGG LVQPGGSLRL SCAASGFTFS LYPMWWVRQA PGKGLEWVSW IVPSGGFTLY  60
ADSVKGRFTI SRDNSKNTLY LQMNSLRAED TAVYYCAKDR AYGDYVGWNG FDYWGQGTLV 120
TVSS                                                            124

LC for Fab M269-G10

(SEQ ID NO: 726)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK             108

HC for Fab M269-G10

(SEQ ID NO: 727)
EVQLLESGGG LVQPGGSLRL SCAASGFTFS LYPMWWVRQA PGKGLEWVSY ISPSGGGTLY  60
ADSVKGRFTI SRDNSKNTLY LQMNSLRAED TAVYYCAKDR AYGDYVGWNG FDYWGQGTLV 120
TVSS                                                            124

LC for Fab M274-A12

(SEQ ID NO: 728)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK             108

HC for Fab M274-A12

(SEQ ID NO: 729)
EVQLLESGGG LVQPGGSLRL SCAASGFTFS LYPMWWVRQA PGKGLEWVSY ISSSGGGTYY  60
ADSVKGRFTI SRDNSKNTLY LQMNSLRAED TAVYYCAKDR AYGDYVGWNG FDYWGQGTLV 120
TVSS                                                            124

LC for Fab M272-B10

(SEQ ID NO: 730)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK             108

HC for Fab M272-B10

(SEQ ID NO: 731)
EVQLLESGGG LVQPGGSLRL SCAASGFTFS LYPMWWVRQA PGKGLEWVSY IVPSGGGTFY  60
ADSVKGRFTI SRDNSKNTLY LQMNSLRAED TAVYYCAKDR AYGDYVGWNG FDYWGQGTLV 120
TVSS                                                            124

LC for Fab M302-A05

(SEQ ID NO: 732)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK             108

HC for Fab M302-A05

(SEQ ID NO: 733)
EVQLLESGGG LVQPGGSLRL SCAASGFTFS LYPMWWVRQA PGKGLEWVSY IVSSGGATFY  60
ADSVKGRFTI SRDNSKNTLY LQMNSLRAED TAVYYCAKDR AYGDYVGWNG FDYWGQGTLV 120
TVSS                                                            124

LC for Fab M273-D07

(SEQ ID NO: 734)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK             108

HC for Fab M273-D07

(SEQ ID NO: 735)
EVQLLESGGG LVQPGGSLRL SCAASGFTFS LYPMWWVRQA PGKGLEWVSY IYPSGGATMY  60
ADSVKGRFTI SRDNSKNTLY LQMNSLRAED TAVYYCAKDR AYGDYVGWNG FDYWGQGTLV 120
TVSS                                                            124

LC for Fab M274-C03

(SEQ ID NO: 736)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK             108

HC for Fab M274-C03

(SEQ ID NO: 737)
EVQLLESGGG LVQPGGSLRL SCAASGFTFS LYQMWWVRQA PGKGLEWVSV IYPSGGATYY  60
ADSVKGRFTI SRDNSKNTLY LQMNSLRAED TAVYYCAKDR AYGDYVGWNG FDYWGQGTLV 120
TVSS                                                            124

LC for Fab M272-E09

(SEQ ID NO: 738)
QDIQMTQSPA TLSLSPGERA TLSCRASQSI SSFLAWYQQK PGQAPRLLIY DASYRATGIP  60
ARFSGSGSGT DFTLTISSLE PEDYAVYYCQ QRGNWPITFG QGTRLEIK             108

```
HC for Fab M272-E09
                                                    (SEQ ID NO: 739)
EVQLLESGGG LVQPGGSLRL SCAASGFTFS LYQMWWVRQA PGKGLEWVSV IYPSGGTFYA        60
DSVKGRFTIS RDNSKNTLYL QMNSLRAEDT AVYYCAKDRA YGDYVGWNGF DYWGQGTLVT       120
VSS                                                                    123

LC for Fab M298-G03
                                                    (SEQ ID NO: 740)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M298-G03
                                                    (SEQ ID NO: 741)
EVQLLESGGG LVQPGGSLRL SCAASGFTFS MYDMWWVRQA PGKGLEWVSV ISPSGGGTFY        60
ADSVKGRFTI SRDNSKNTLY LQMNSLRAED TAVYYCAKDR AYGDYVGWNG FDWGQGTLV        120
TVSS                                                                   124

LC for Fab M268-E04
                                                    (SEQ ID NO: 742)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M268-E04
                                                    (SEQ ID NO: 743)
EVQLLESGGG LVQPGGSLRL SCAASGFTFS MYDMWWVRQA PGKGLEWVSV IYPSGGNTLY        60
ADSVKGRFTI SRDNSKNTLY LQMNSLRAED TAVYYCAKDR AYGDYVGWNG FDWGQGTLV        120
TVSS                                                                   124

LC for Fab M270-A08
                                                    (SEQ ID NO: 744)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M270-A08
                                                    (SEQ ID NO: 745)
EVQLLESGGG LVQPGGSLRL SCAASGFTFS MYDMWWVRQA PGKGLEWVSV IYPSGGPTFY        60
ADSVKGRFTI SRDNSKNTLY LQMNSLRAED TAVYYCAKDR AYGDYVGWNG FDWGQGTLV        120
TVSS                                                                   124

LC for Fab M268-C07
                                                    (SEQ ID NO: 746)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M268-C07
                                                    (SEQ ID NO: 747)
EVQLLESGGG LVQPGGSLRL SCAASGFTFS MYDMWWVRQA PGKGLEWVSV IYPSGGYTAY        60
ADSVKGRFTI SRDNSKNTLY LQMNSLRAED TAVYYCAKDR AYGDYVGWNG FDWGQGTLV        120
TVSS                                                                   124

LC for Fab M268-F02
                                                    (SEQ ID NO: 748)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M268-F02
                                                    (SEQ ID NO: 749)
EVQLLESGGG LVQPGGSLRL SCAASGFTFS MYDMWWVRQA PGKGLEWVSV IYSSGGFTDY        60
ADSVKGRFTI SRDNSKNTLY LQMNSLRAED TAVYYCAKDR AYGDYVGWNG FDWGQGTLV        120
TVSS                                                                   124

LC for Fab M271-A05
                                                    (SEQ ID NO: 750)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M271-A05
                                                    (SEQ ID NO: 751)
EVQLLESGGG LVQPGGSLRL SCAASGFTFS MYDMWWVRQA PGKGLEWVSV IYSSGGPTFY        60
ADSVKGRFTI SRDNSKNTLY LQMNSLRAED TAVYYCAKDR AYGDYVGWNG FDWGQGTLV        120
TVSS                                                                   124

LC for Fab M270-C12
                                                    (SEQ ID NO: 752)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108
```

HC for Fab M270-C12

(SEQ ID NO: 753)
```
EVQLLESGGG LVQPGGSLRL SCAASGFTFS MYDMWWVRQA PGKGLEWVSV IYSSGGVTFY    60
ADSVKGRFTI SRDNSKNTLY LQMNSLRAED TAVYYCAKDR AYGDYVGWNG FDYWGQGTLV   120
TVSS                                                                124
```

LC for Fab M272-A02

(SEQ ID NO: 754)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M272-A02

(SEQ ID NO: 755)
```
EVQLLESGGG LVQPGGSLRL SCAASGFTFS MYDMWWVRQA PGKGLEWVSV IYSSGGYTAY    60
ADSVKGRFTI SRDNSKNTLY LQMNSLRAED TAVYYCAKDR AYGDYVGWNG FDYWGQGTLV   120
TVSS                                                                124
```

LC for Fab M299-F03

(SEQ ID NO: 756)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M299-F03

(SEQ ID NO: 757)
```
EVQLLESGGG LVQPGGSLRL SCAASGFTFS MYDMWWVRQA PGKGLEWVSV IYSSGGYTDY    60
ADSVKGRFTI SRDNSKNTLY LQMNSLRAED TAVYYCAKDR AYGDYVGWNG FDYWGQGTLV   120
TVSS                                                                124
```

LC for Fab M272-F05

(SEQ ID NO: 758)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M272-F05

(SEQ ID NO: 759)
```
EVQLLESGGG LVQPGGSLRL SCAASGFTFS MYDMWWVRQA PGKGLEWVSV IYSSGGYTNY    60
ADSVKGRFTI SRDNSKNTLY LQMNSLRAED TAVYYCAKDR AYGDYVGWNG FDYWGQGTLV   120
TVSS                                                                124
```

LC for Fab M301-D12

(SEQ ID NO: 760)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M301-D12

(SEQ ID NO: 761)
```
EVQLLESGGG LVQPGGSLRL SCAASGFTFS MYDMWWVRQA PGKGLEWVSV IYSSGGYTSY    60
ADSVKGRFTI SRDNSKNTLY LQMNSLRAED TAVYYCAKDR AYGDYVGWNG FDYWGQGTLV   120
TVSS                                                                124
```

LC for Fab M276-B10

(SEQ ID NO: 762)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M276-B10

(SEQ ID NO: 763)
```
EVQLLESGGG LVQPGGSLRL SCAASGFTFS MYDMWWVRQA PGKGLEWVSY ISSSGGSTLY    60
ADSVKGRFTI SRDNSKNTLY LQMNSLRAED TAVYYCAKDR AYGDYVGWNG FDYWGQGTLV   120
TVSS                                                                124
```

LC for Fab M270-B05

(SEQ ID NO: 764)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M270-B05

(SEQ ID NO: 765)
```
EVQLLESGGG LVQPGGSLRL SCAASGFTFS MYMMIWVRQA PGKGLEWVSS IYPSGGFTSY    60
ADSVKGRFTI SRDNSKNTLY LQMNSLRAED TAVYYCAKDR AYGDYVGWNG FDYWGQGTLV   120
TVSS                                                                124
```

LC for Fab M277-E11

(SEQ ID NO: 766)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

-continued

HC for Fab M277-E11

(SEQ ID NO: 767)
EVQLLESGGG LVQPGGSLRL SCAASGFTFS MYNMWVRQA PGKGLEWVSS ISPSGGATYY    60
ADSVKGRFTI SRDNSKNTLY LQMNSLRAED TAVYYCAKDR AYGDYVGWNG FDYWGQGTLV  120
TVSS                                                              124

LC for Fab M304-E02

(SEQ ID NO: 768)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M304-E02

(SEQ ID NO: 769)
EVQLLESGGG LVQPGGSLRL SCAASGFTFS MYPIIWVRQA PGKGLEWVSY ISPSGGFTGY   60
ADSVKGRFTI SRDNSKNTLY LQMNSLRAED TAVYYCAKDR AYGDYVGWNG FDYWGQGTLV  120
TVSS                                                              124

LC for Fab M307-E12

(SEQ ID NO: 770)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M307-E12

(SEQ ID NO: 771)
EVQLLESGGG LVQPGGSLRL SCAASGFTFS MYPMFWVRQA PGKGLEWVSY ISPSGGWTAY   60
ADSVKGRFTI SRDNSKNTLY LQMNSLRAED TAVYYCAKDR AYGDYVGWNG FDYWGQGTLV  120
TVSS                                                              124

LC for Fab M271-H07

(SEQ ID NO: 772)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M271-H07

(SEQ ID NO: 773)
EVQLLESGGG LVQPGGSLRL SCAASGFTFS MYPMFWVRQA PGKGLEWVSY ISPSGGWTDY   60
ADSVKGRFTI SRDNSKNTLY LQMNSLRAED TAVYYCAKDR AYGDYVGWNG FDYWGQGTLV  120
TVSS                                                              124

LC for Fab M274-C01

(SEQ ID NO: 774)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M274-C01

(SEQ ID NO: 775)
EVQLLESGGG LVQPGGSLRL SCAASGFTFS MYPMFWVRQA PGKGLEWVSY IVPSGGWTDY   60
ADSVKGRFTI SRDNSKNTLY LQMNSLRAED TAVYYCAKDR AYGDYVGWNG FDYWGQGTLV  120
TVSS                                                              124

LC for Fab M268-D03

(SEQ ID NO: 776)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M268-D03

(SEQ ID NO: 777)
EVQLLESGGG LVQPGGSLRL SCAASGFTFS MYPMIWVRQA PGKGLEWVSY ISPSGGGTFY   60
ADSVKGRFTI SRDNSKNTLY LQMNSLRAED TAVYYCAKDR AYGDYVGWNG FDYWGQGTLV  120
TVSS                                                              124

LC for Fab M272-H01

(SEQ ID NO: 778)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M272-H01

(SEQ ID NO: 779)
EVQLLESGGG LVQPGGSLRL SCAASGFTFS MYPMIWVRQA PGKGLEWVSY IVPSGGFTGY   60
ADSVKGRFTI SRDNSKNTLY LQMNSLRAED TAVYYCAKDR AYGDYVGWNG FDYWGQGTLV  120
TVSS                                                              124

LC for Fab M302-B06

(SEQ ID NO: 780)
QDIQMTQSPA TLSLSPGERA TLSCRASQSI SSFLAWYQQK PGQAPRLLIY DASYRATGIP   60
ARFSGSGSGT DFTLTISSLE PEDYAVYYCQ QRGNWPITFG QGTRLEIK              108

HC for Fab M302-B06

(SEQ ID NO: 781)
```
EVQLLESGGG LVQPGGSLRL SCAASGFTFS MYPMLWVRQA PGKGLEWVSY ISPSGGYTGY    60
ADSVKGRFTI SRDNSKNTLY LQMNSLRAED TAVYYCAKDR AYGDYVGWNG FDYWGQGTLV   120
TVSS                                                                124
```

LC for Fab M270-B11

(SEQ ID NO: 782)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M270-B11

(SEQ ID NO: 783)
```
EVQLLESGGG LVQPGGSLRL SCAASGFTFS MYPMTWVRQA PGKGLEWVSY ISPSGGYTGY    60
ADSVKGRFTI SRDNSKNTLY LQMNSLRAED TAVYYCAKDR AYGDYVGWNG FDYWGQGTLV   120
TVSS                                                                124
```

LC for Fab M277-A10

(SEQ ID NO: 784)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M277-A10

(SEQ ID NO: 785)
```
EVQLLESGGG LVQPGGSLRL SCAASGFTFS MYSMWWVRQA PGKGLEWVSV IYPSGGFTDY    60
ADSVKGRFTI SRDNSKNTLY LQMNSLRAED TAVYYCAKDR AYGDYVGWNG FDYWGQGTLV   120
TVSS                                                                124
```

LC for Fab M302-G12

(SEQ ID NO: 786)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M302-G12

(SEQ ID NO: 787)
```
EVQLLESGGG LVQPGGSLRL SCAASGFTFS MYWMLWVRQA PGKGLEWVSY ISPSGGGTFY    60
ADSVKGRFTI SRDNSKNTLY LQMNSLRAED TAVYYCAKDR AYGDYVGWNG FDYWGQGTLV   120
TVSS                                                                124
```

LC for Fab M276-C01

(SEQ ID NO: 788)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M276-C01

(SEQ ID NO: 789)
```
EVQLLESGGG LVQPGGSLRL SCAASGFTFS MYWMWWVRQA PGKGLEWVSS ISSSGGYTGY    60
ADSVKGRFTI SRDNSKNTLY LQMNSLRAED TAVYYCAKDR AYGDYVGWNG FDYWGQGTLV   120
TVSS                                                                124
```

LC for Fab M276-E07

(SEQ ID NO: 790)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M276-E07

(SEQ ID NO: 791)
```
EVQLLESGGG LVQPGGSLRL SCAASGFTFS NYAMWWVRQA PGKGLEWVSY ISPSGATYYA    60
DSVKGRFTIS RDNSKNTLYL QMNSLRAEDT AVYYCAKDRA YGDYVGWNGF DYWGQGTLVT   120
VSS                                                                 123
```

LC for Fab M268-C06

(SEQ ID NO: 792)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M268-C06

(SEQ ID NO: 793)
```
EVQLLESGGG LVQPGGSLRL SCAASGFTFS NYAMWWVRQA PGKGLEWVSY ISPSGGSTYY    60
ADSVKGRFTI SRDNSKNTLY LQMNSLRAED TAVYYCAKDR AYGDYVGWNG FDYWGQGTLV   120
TVSS                                                                124
```

LC for Fab M273-F02

(SEQ ID NO: 794)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

HC for Fab M273-F02
(SEQ ID NO: 795)
EVQLLESGGG LVQPGGSLRL SCAASGFTFS NYDMAWVRQA PGKGLEWVSW ISSSGGFTDY    60
ADSVKGRFTI SRDNSKNTLY LQMNSLRAED TAVYYCAKDR AYGDYVGWNG FDYWGQGTLV   120
TVSS                                                                124

LC for Fab M270-B01
(SEQ ID NO: 796)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M270-B01
(SEQ ID NO: 797)
EVQLLESGGG LVQPGGSLRL SCAASGFTFS NYDMIWVRQA PGKGLEWVSV ISPSGGWTSY    60
ADSVKGRFTI SRDNSKNTLY LQMNSLRAED TAVYYCAKDR AYGDYVGWNG FDYWGQGTLV   120
TVSS                                                                124

LC for Fab M276-G04
(SEQ ID NO: 798)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M276-G04
(SEQ ID NO: 799)
EVQLLESGGG LVQPGGSLRL SCAASGFTFS NYDMIWVRQA PGKGLEWVSY IVPSGGYTAY    60
ADSVKGRFTI SRDNSKNTLY LQMNSLRAED TAVYYCAKDR AYGDYVGWNG FDYWGQGTLV   120
TVSS                                                                124

LC for Fab M270-H01
(SEQ ID NO: 800)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M270-H01
(SEQ ID NO: 801)
EVQLLESGGG LVQPGGSLRL SCAASGFTFS NYDMWWVRQA PGKGLEWVSV ISPSGGFTGY    60
ADSVKGRFTI SRDNSKNTLY LQMNSLRAED TAVYYCAKDR AYGDYVGWNG FDYWGQGTLV   120
TVSS                                                                124

LC for Fab M270-A10
(SEQ ID NO: 802)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M270-A10
(SEQ ID NO: 803)
EVQLLESGGG LVQPGGSLRL SCAASGFTFS NYDMWWVRQA PGKGLEWVSV ISSSGGYTGY    60
ADSVKGRFTI SRDNSKNTLY LQMNSLRAED TAVYYCAKDR AYGDYVGWNG FDYWGQGTLV   120
TVSS                                                                124

LC for Fab M269-A01
(SEQ ID NO: 804)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M269-A01
(SEQ ID NO: 805)
EVQLLESGGG LVQPGGSLRL SCAASGFTFS NYDMWWVRQA PGKGLEWVSV ISSSGMTYYA    60
DSVKGRFTIS RDNSKNTLYL QMNSLRAEDT AVYYCAKDRA YGDYVGWNGF DYWGQGTLVT   120
VSS                                                                 123

LC for Fab M271-E06
(SEQ ID NO: 806)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-E06
(SEQ ID NO: 807)
EVQLLESGGG LVQPGGSLRL SCAASGFTFS NYDMWWVRQA PGKGLEWVSV IVPSGGATYY    60
ADSVKGRFTI SRDNSKNTLY LQMNSLRAED TAVYYCAKDR AYGDYVGWNG FDYWGQGTLV   120
TVSS                                                                124

LC for Fab M271-F01
(SEQ ID NO: 808)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

```
HC for Fab M271-F01
                                                             (SEQ ID NO: 809)
EVQLLESGGG LVQPGGSLRL SCAASGFTFS NYDMWWVRQA PGKGLEWVSV IYPSGGATFY    60
ADSVKGRFTI SRDNSKNTLY LQMNSLRAED TAVYYCAKDR AYGDYVGWNG FDYWGQGTLV   120
TVSS                                                               124

LC for Fab M271-E04
                                                             (SEQ ID NO: 810)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M271-E04
                                                             (SEQ ID NO: 811)
EVQLLESGGG LVQPGGSLRL SCAASGFTFS NYDMWWVRQA PGKGLEWVSV IYPSGGITYY    60
ADSVKGRFTI SRDNSKNTLY LQMNSLRAED TAVYYCAKDR AYGDYVGWNG FDYWGQGTLV   120
TVSS                                                               124

LC for Fab M305-H10
                                                             (SEQ ID NO: 812)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M305-H10
                                                             (SEQ ID NO: 813)
EVQLLESGGG LVQPGGSLRL SCAASGFTFS NYDMWWVRQA PGKGLEWVSV IYPSGGPTYY    60
ADSVKGRFTI SRDNSKNTLY LQMNSLRAED TAVYYCAKDR AYGDYVGWNG FDYWGQGTLV   120
TVSS                                                               124

LC for Fab M272-D03
                                                             (SEQ ID NO: 814)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M272-D03
                                                             (SEQ ID NO: 815)
EVQLLESGGG LVQPGGSLRL SCAASGFTFS NYDMWWVRQA PGKGLEWVSV IYPSGGYTVY    60
ADSVKGRFTI SRDNSKNTLY LQMNSLRAED TAVYYCAKDR AYGDYVGWNG FDYWGQGTLV   120
TVSS                                                               124

LC for Fab M270-E12
                                                             (SEQ ID NO: 816)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M270-E12
                                                             (SEQ ID NO: 817)
EVQLLESGGG LVQPGGSLRL SCAASGFTFS NYDMWWVRQA PGKGLEWVSV IYSSGGPTYY    60
ADSVKGRFTI SRDNSKNTLY LQMNSLRAED TAVYYCAKDR AYGDYVGWNG FDYWGQGTLV   120
TVSS                                                               124

LC for Fab M299-A04
                                                             (SEQ ID NO: 818)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M299-A04
                                                             (SEQ ID NO: 819)
EVQLLESGGG LVQPGGSLRL SCAASGFTFS NYDMWWVRQA PGKGLEWVSV IYSSGGYTAY    60
ADSVKGRFTI SRDNSKNTLY LQMNSLRAED TAVYYCAKDR AYGDYVGWNG FDYWGQGTLV   120
TVSS                                                               124

LC for Fab M269-C03
                                                             (SEQ ID NO: 820)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M269-C03
                                                             (SEQ ID NO: 821)
EVQLLESGGG LVQPGGSLRL SCAASGFTFS NYDMWWVRQA PGKGLEWVSW ISSSGGATIY    60
ADSVKGRFTI SRDNSKNTLY LQMNSLRAED TAVYYCAKDR AYGDYVGWNG FDYWGQGTLV   120
TVSS                                                               124

LC for Fab M274-E09
                                                             (SEQ ID NO: 822)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108
```

-continued

HC for Fab M274-E09

(SEQ ID NO: 823)
```
EVQLLESGGG LVQPGGSLRL SCAASGFTFS NYDMWWVRQA PGKGLEWVSY ISSSGGATLY    60
ADSVKGRFTI SRDNSKNTLY LQMNSLRAED TAVYYCAKDR AYGDYVGWNG FDYWGQGTLV  120
TVSS                                                              124
```

LC for Fab M269-E04

(SEQ ID NO: 824)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK              108
```

HC for Fab M269-E04

(SEQ ID NO: 825)
```
EVQLLESGGG LVQPGGSLRL SCAASGFTFS NYEMWWVRQA PGKGLEWVSV IYSSGSATFY    60
ADSVKGRFTI SRDNSKNTLY LQMNSLRAED TAVYYCAKDR AYGDYVGWNG FDYWGQGTLV  120
TVSS                                                              124
```

LC for Fab M271-F07

(SEQ ID NO: 826)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK              108
```

HC for Fab M271-F07

(SEQ ID NO: 827)
```
EVQLLESGGG LVQPGGSLRL SCAASGFTFS NYIMWWVRQA PGKGLEWVSS IYPSGGATLY    60
ADSVKGRFTI SRDNSKNTLY LQMNSLRAED TAVYYCAKDR AYGDYVGWNG FDYWGQGTLV  120
TVSS                                                              124
```

LC for Fab M272-F12

(SEQ ID NO: 828)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK              108
```

HC for Fab M272-F12

(SEQ ID NO: 829)
```
EVQLLESGGG LVQPGGSLRL SCAASGFTFS NYMMIWVRQA PGKGLEWVSS IYPSGGYTGY    60
ADSVKGRFTI SRDNSKNTLY LQMNSLRAED TAVYYCAKDR AYGDYVGWNG FDYWGQGTLV  120
TVSS                                                              124
```

LC for Fab M272-C01

(SEQ ID NO: 830)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK              108
```

HC for Fab M272-C01

(SEQ ID NO: 831)
```
EVQLLESGGG LVQPGGSLRL SCAASGFTFS NYMMIWVRQA PGKGLEWVSS IYSSGGFTSY    60
ADSVKGRFTI SRDNSKNTLY LQMNSLRAED TAVYYCAKDR AYGDYVGWNG FDYWGQGTLV  120
TVSS                                                              124
```

LC for Fab M275-B11

(SEQ ID NO: 832)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK              108
```

HC for Fab M275-B11

(SEQ ID NO: 833)
```
EVQLLESGGG LVQPGGSLRL SCAASGFTFS NYMMWWVRQA PGKGLEWVSS IGPSGGGTFY    60
ADSVKGRFTI SRDNSKNTLY LQMNSLRAED TAVYYCAKDR AYGDYVGWNG FDYWGQGTLV  120
TVSS                                                              124
```

LC for Fab M275-F12

(SEQ ID NO: 834)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK              108
```

HC for Fab M275-F12

(SEQ ID NO: 835)
```
EVQLLESGGG LVQPGGSLRL SCAASGFTFS NYMMWWVRQA PGKGLEWVSS IYSSGGGTFY    60
ADSVKGRFTI SRDNSKNTLY LQMNSLRAED TAVYYCAKDR AYGDYVGWNG FDYWGQGTLV  120
TVSS                                                              124
```

LC for Fab M268-C10

(SEQ ID NO: 836)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK              108
```

```
HC for Fab M268-C10
                                                        (SEQ ID NO: 837)
EVQLLESGGG LVQPGGSLRL SCAASGFTFS NYMMWWVRQA PGKGLEWVSV ISPSGGATYY       60
ADSVKGRFTI SRDNSKNTLY LQMNSLRAED TAVYYCAKDR AYGDYVGWNG FDYWGQGTLV      120
TVSS                                                                  124

LC for Fab M303-C05
                                                        (SEQ ID NO: 838)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M303-C05
                                                        (SEQ ID NO: 839)
EVQLLESGGG LVQPGGSLRL SCAASGFTFS NYNMMWVRQA PGKGLEWVSY ISSSGGYTGY       60
ADSVKGRFTI SRDNSKNTLY LQMNSLRAED TAVYYCAKDR AYGDYVGWNG FDYWGQGTLV      120
TVSS                                                                  124

LC for Fab M274-E08
                                                        (SEQ ID NO: 840)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M274-E08
                                                        (SEQ ID NO: 841)
EVQLLESGGG LVQPGGSLRL SCAASGFTFS NYNMWWVRQA PGKGLEWVSV IYPSGGPTFY       60
ADSVKGRFTI SRDNSKNTLY LQMNSLRAED TAVYYCAKDR AYGDYVGWNG FDYWGQGTLV      120
TVSS                                                                  124

LC for Fab M276-D12
                                                        (SEQ ID NO: 842)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M276-D12
                                                        (SEQ ID NO: 843)
EVQLLESGGG LVQPGGSLRL SCAASGFTFS NYNMWWVRQA PGKGLEWVSY ISPSGGGTLY       60
ADSVKGRFTI SRDNSKNTLY LQMNSLRAED TAVYYCAKDR AYGDYVGWNG FDYWGQGTLV      120
TVSS                                                                  124

LC for Fab M299-A02
                                                        (SEQ ID NO: 844)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M299-A02
                                                        (SEQ ID NO: 845)
EVQLLESGGG LVQPGGSLRL SCAASGFTFS NYPMFWVRQA PGKGLEWVSY ISPSGGWTSY       60
ADSVKGRFTI SRDNSKNTLY LQMNSLRAED TAVYYCAKDR AYGDYVGWNG FDYWGQGTLV      120
TVSS                                                                  124

LC for Fab M268-C05
                                                        (SEQ ID NO: 846)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M268-C05
                                                        (SEQ ID NO: 847)
EVQLLESGGG LVQPGGSLRL SCAASGFTFS NYPMIWVRQA PGKGLEWVSY ISPSGGGTFY       60
ADSVKGRFTI SRDNSKNTLY LQMNSLRAED TAVYYCAKDR AYGDYVGWNG FDYWGQGTLV      120
TVSS                                                                  124

LC for Fab M276-H10
                                                        (SEQ ID NO: 848)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M276-H10
                                                        (SEQ ID NO: 849)
EVQLLESGGG LVQPGGSLRL SCAASGFTFS NYPMIWVRQA PGKGLEWVSY ISSSGGYTGY       60
ADSVKGRFTI SRDNSKNTLY LQMNSLRAED TAVYYCAKDR AYGDYVGWNG FDYWGQGTLV      120
TVSS                                                                  124

LC for Fab M270-F10
                                                        (SEQ ID NO: 850)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108
```

HC for Fab M270-F10

(SEQ ID NO: 851)
EVQLLESGGG LVQPGGSLRL SCAASGFTFS NYPMIWVRQA PGKGLEWVSY IVPSGGFTSY    60
ADSVKGRFTI SRDNSKNTLY LQMNSLRAED TAVYYCAKDR AYGDYVGWNG FDYWGQGTLV   120
TVSS                                                               124

LC for Fab M271-F12

(SEQ ID NO: 852)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-F12

(SEQ ID NO: 853)
EVQLLESGGG LVQPGGSLRL SCAASGFTFS NYPMIWVRQA PGKGLEWVSY IYPSGGGTYY    60
ADSVKGRFTI SRDNSKNTLY LQMNSLRAED TAVYYCAKDR AYGDYVGWNG FDYWGQGTLV   120
TVSS                                                               124

LC for Fab M301-108

(SEQ ID NO: 854)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M301-H08

(SEQ ID NO: 855)
EVQLLESGGG LVQPGGSLRL SCAASGFTFS NYPMIWVRQA PGKGLEWVSY IYPSGGTFYA    60
DSVKGRFTIS RDNSKNTLYL QMNSLRAEDT AVYYCAKDRA YGDYVGWNGF DYWGQGTLVT   120
VSS                                                                123

LC for Fab M304-D02

(SEQ ID NO: 856)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M304-D02

(SEQ ID NO: 857)
EVQLLESGGG LVQPGGSLRL SCAASGFTFS NYPMWVRQA PGKGLEWVSS ISPSGGSTYY    60
ADSVKGRFTI SRDNSKNTLY LQMNSLRAED TAVYYCAKDR AYGDYVGWNG FDYWGQGTLV   120
TVSS                                                               124

LC for Fab M268-G02

(SEQ ID NO: 858)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M268-G02

(SEQ ID NO: 859)
EVQLLESGGG LVQPGGSLRL SCAASGFTFS NYPMWVRQA PGKGLEWVSS IVPSGGATYY    60
ADSVKGRFTI SRDNSKNTLY LQMNSLRAED TAVYYCAKDR AYGDYVGWNG FDYWGQGTLV   120
TVSS                                                               124

LC for Fab M271-D07

(SEQ ID NO: 860)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-D07

(SEQ ID NO: 861)
EVQLLESGGG LVQPGGSLRL SCAASGFTFS NYPMWVRQA PGKGLEWVSS IYPSGGATFY    60
ADSVKGRFTI SRDNSKNTLY LQMNSLRAED TAVYYCAKDR AYGDYVGWNG FDYWGQGTLV   120
TVSS                                                               124

LC for Fab M269-F06

(SEQ ID NO: 862)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M269-F06

(SEQ ID NO: 863)
EVQLLESGGG LVQPGGSLRL SCAASGFTFS NYPMWVRQA PGKGLEWVSS IYPSGGKATY    60
YADSVKGRFT ISRDNSKNTL YLQMNSLRAE DTAVYYCAKD RAYGDYVGWN GFDYWGQGTL   120
VTVSS                                                              125

LC for Fab M271-H11

(SEQ ID NO: 864)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M271-H11

(SEQ ID NO: 865)

```
EVQLLESGGG LVQPGGSLRL SCAASGFTFS NYPMWWVRQA PGKGLEWVSS IYPSGGPTFY      60
ADSVKGRFTI SRDNSKNTLY LQMNSLRAED TAVYYCAKDR AYGDYVGWNG FDYWGQGTLV     120
TVSS                                                                  124
```

LC for Fab M275-F05

(SEQ ID NO: 866)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M275-F05

(SEQ ID NO: 867)

```
EVQLLESGGG LVQPGGSLRL SCAASGFTFS NYPMWWVRQA PGKGLEWVSS IYSSGGATFY      60
ADSVKGRFTI SRDNSKNTLY LQMNSLRAED TAVYYCAKDR AYGDYVGWNG FDYWGQGTLV     120
TVSS                                                                  124
```

LC for Fab M300-H06

(SEQ ID NO: 868)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M300-H06

(SEQ ID NO: 869)

```
EVQLLESGGG LVQPGGSLRL SCAASGFTFS NYPMWWVRQA PGKGLEWVSV IYPSGGYTAY      60
ADSVKGRFTI SRDNSKNTLY LQMNSLRAED TAVYYCAKDR AYGDYVGWNG FDYWGQGTLV     120
TVSS                                                                  124
```

LC for Fab M274-B07

(SEQ ID NO: 870)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M274-B07

(SEQ ID NO: 871)

```
EVQLLESGGG LVQPGGSLRL SCAASGFTFS NYPMWWVRQA PGKGLEWVSY IGPSGGGTLY      60
ADSVKGRFTI SRDNSKNTLY LQMNSLRAED TAVYYCAKDR AYGDYVGWNG FDYWGQGTLV     120
TVSS                                                                  124
```

LC for Fab M269-A07

(SEQ ID NO: 872)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M269-A07

SEQ ID NO: 873)

```
EVQLLESGGG LVQPGGSLRL SCAASGFTFS NYPMWWVRQA PGKGLEWVSY IRPSGGPTWY      60
ADSVKGRFTI SRDNSKNTLY LQMNSLRAED TAVYYCAKDR AYGDYVGWNG FDYWGQGTLV     120
TVSS                                                                  124
```

LC for Fab M269-H04

(SEQ ID NO: 874)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M269-H04

(SEQ ID NO: 875)

```
EVQLLESGGG LVQPGGSLRL SCAASGFTFS NYPMWWVRQA PGKGLEWVSY ISPSGGGTFY      60
ADSVKGRFTI SRDNSKNTLY LQMNSLRAED TAVYYCAKDR AYGDYVGWNG FDYWGQGTLV     120
TVSS                                                                  124
```

LC for Fab M306-H02

(SEQ ID NO: 876)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M306-H02

(SEQ ID NO: 877)

```
EVQLLESGGG LVQPGGSLRL SCAASGFTFS NYPMWWVRQA PGKGLEWVSY ISPSGGGTLY      60
ADSVKGRFTI SRDNSKNTLY LQMNSLRAED TAVYYCAKDR AYGDYVGWNG FDYWGQGTLV     120
TVSS                                                                  124
```

LC for Fab M299-C09

(SEQ ID NO: 878)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

-continued

HC for Fab M299-C09

(SEQ ID NO: 879)
EVQLLESGGG LVQPGGSLRL SCAASGFTFS NYPMWWVRQA PGKGLEWVSY IVPSGGATFY    60
ADSVKGRFTI SRDNSKNTLY LQMNSLRAED TAVYYCAKDR AYGDYVGWNG FDYWGQGTLV   120
TVSS                                                               124

LC for Fab M274-D06

(SEQ ID NO: 880)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M274-D06

(SEQ ID NO: 881)
EVQLLESGGG LVQPGGSLRL SCAASGFTFS NYPMWWVRQA PGKGLEWVSY IVPSGGMTYY    60
ADSVKGRFTI SRDNSKNTLY LQMNSLRAED TAVYYCAKDR AYGDYVGWNG FDYWGQGTLV   120
TVSS                                                               124

LC for Fab M303-C12

(SEQ ID NO: 882)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M303-C12

(SEQ ID NO: 883)
EVQLLESGGG LVQPGGSLRL SCAASGFTFS NYSMWWVRQA PGKGLEWVSV IYPSGGYTSY    60
ADSVKGRFTI SRDNSKNTLY LQMNSLRAED TAVYYCAKDR AYGDYVGWNG FDYWGQGTLV   120
TVSS                                                               124

LC for Fab M273-D11

(SEQ ID NO: 884)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M273-D11

(SEQ ID NO: 885)
EVQLLESGGG LVQPGGSLRL SCAASGFTFS NYYMIWVRQA PGKGLEWVSY ISPSGGGTYY    60
ADSVKGRFTI SRDNSKNTLY LQMNSLRAED TAVYYCAKDR AYGDYVGWNG FDYWGQGTLV   120
TVSS                                                               124

LC for Fab M268-G04

(SEQ ID NO: 886)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M268-G04

(SEQ ID NO: 887)
EVQLLESGGG LVQPGGSLRL SCAASGFTFS PYAMWWVRQA PGKGLEWVSY ISSSGGGTFY    60
ADSVKGRFTI SRDNSKNTLY LQMNSLRAED TAVYYCAKDR AYGDYVGWNG FDYWGQGTLV   120
TVSS                                                               124

LC for Fab M299-D01

(SEQ ID NO: 888)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M299-D01

(SEQ ID NO: 889)
EVQLLESGGG LVQPGGSLRL SCAASGFTFS PYDMWWVRQA PGKGLEWVSV ISPSGGATFY    60
ADSVKGRFTI SRDNSKNTLY LQMNSLRAED TAVYYCAKDR AYGDYVGWNG FDYWGQGTLV   120
TVSS                                                               124

LC for Fab M303-G04

(SEQ ID NO: 890)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M303-G04

(SEQ ID NO: 891)
EVQLLESGGG LVQPGGSLRL SCAASGFTFS PYDMWWVRQA PGKGLEWVSV ISPSGGYTGY    60
ADSVKGRFTI SRDNSKNTLY LQMNSLRAED TAVYYCAKDR AYGDYVGWNG FDYWGQGTLV   120
TVSS                                                               124

LC for Fab M271-C05

(SEQ ID NO: 892)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

```
HC for Fab M271-C05
                                                       (SEQ ID NO: 893)
EVQLLESGGG LVQPGGSLRL SCAASGFTFS PYDMWWVRQA PGKGLEWVSV ISSSGGFTDY      60
ADSVKGRFTI SRDNSKNTLY LQMNSLRAED TAVYYCAKDR AYGDYVGWNG FDYWGQGTLV    120
TVSS                                                                 124

LC for Fab M271-F04
                                                       (SEQ ID NO: 894)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M271-F04
                                                       (SEQ ID NO: 895)
EVQLLESGGG LVQPGGSLRL SCAASGFTFS PYMMFWVRQA PGKGLEWVSS ISSSGGGTFY     60
ADSVKGRFTI SRDNSKNTLY LQMNSLRAED TAVYYCAKDR AYGDYVGWNG FDYWGQGTLV    120
TVSS                                                                 124

LC for Fab M275-E05
                                                       (SEQ ID NO: 896)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-H12
                                                       (SEQ ID NO: 897)
EVQLLESGGG LVQPGGSLRL SCAASGFTFS PYMMIWVRQA PGKGLEWVSS ISSSGGYTGY     60
ADSVKGRFTI SRDNSKNTLY LQMNSLRAED TAVYYCAKDR AYGDYVGWNG FDYWGQGTLV    120
TVSS                                                                 124

LC for Fab M269-H12
                                                       (SEQ ID NO: 898)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-H12
                                                       (SEQ ID NO: 899)
EVQLLESGGG LVQPGGSLRL SCAASGFTFS PYMMSWVRQA PGKGLEWVSS IYSSGGATFY     60
ADSVKGRFTI SRDNSKNTLY LQMNSLRAED TAVYYCAKDR AYGDYVGWNG FDYWGQGTLV    120
TVSS                                                                 124

LC for Fab M270-C02
                                                       (SEQ ID NO: 900)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M270-C02
                                                       (SEQ ID NO: 901)
EVQLLESGGG LVQPGGSLRL SCAASGFTFS PYMMWWVRQA PGKGLEWVSS ISSSGGGTFY     60
ADSVKGRFTI SRDNSKNTLY LQMNSLRAED TAVYYCAKDR AYGDYVGWNG FDYWGQGTLV    120
TVSS                                                                 124

LC for Fab M272-F09
                                                       (SEQ ID NO: 902)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M272-F09
                                                       (SEQ ID NO: 903)
EVQLLESGGG LVQPGGSLRL SCAASGFTFS PYNMWWVRQA PGKGLEWVSV IYPSGGATFY     60
ADSVKGRFTI SRDNSKNTLY LQMNSLRAED TAVYYCAKDR AYGDYVGWNG FDYWGQGTLV    120
TVSS                                                                 124

LC for Fab M275-F04
                                                       (SEQ ID NO: 904)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M275-F04
                                                       (SEQ ID NO: 905)
EVQLLESGGG LVQPGGSLRL SCAASGFTFS PYPMFWVRQA PGKGLEWVSS ISPSGGATYY     60
ADSVKGRFTI SRDNSKNTLY LQMNSLRAED TAVYYCAKDR AYGDYVGWNG FDYWGQGTLV    120
TVSS                                                                 124

LC for Fab M305-G11
                                                       (SEQ ID NO: 906)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108
```

-continued

HC for Fab M305-G11
(SEQ ID NO: 907)
EVQLLESGGG LVQPGGSLRL SCAASGFTFS PYPMIWVRQA PGKGLEWVSY IGSSGGYTSY    60
ADSVKGRFTI SRDNSKNTLY LQMNSLRAED TAVYYCAKDR AYGDYVGWNG FDYWGQGTLV   120
TVSS                                                                124

LC for Fab M269-C10
(SEQ ID NO: 908)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M269-C10
(SEQ ID NO: 909)
EVQLLESGGG LVQPGGSLRL SCAASGFTFS PYPMIWVRQA PGKGLEWVSY ISPSGGFTDY    60
ADSVKGRFTI SRDNSKNTLY LQMNSLRAED TAVYYCAKDR AYGDYVGWNG FDYWGQGTLV   120
TVSS                                                                124

LC for Fab M277-A04
(SEQ ID NO: 910)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M277-A04
(SEQ ID NO: 911)
EVQLLESGGG LVQPGGSLRL SCAASGFTFS PYPMIWVRQA PGKGLEWVSY ISPSGGGTFY    60
ADSVKGRFTI SRDNSKNTLY LQMNSLRAED TAVYYCAKDR AYGDYVGWNG FDYWGQGTLV   120
TVSS                                                                124

LC for Fab M274-G05
(SEQ ID NO: 912)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M274-G05
(SEQ ID NO: 913)
EVQLLESGGG LVQPGGSLRL SCAASGFTFS PYPMIWVRQA PGKGLEWVSY ISSSGGGTYY    60
ADSVKGRFTI SRDNSKNTLY LQMNSLRAED TAVYYCAKDR AYGDYVGWNG FDYWGQGTLV   120
TVSS                                                                124

LC for Fab M271-F10
(SEQ ID NO: 914)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M271-F10
(SEQ ID NO: 915)
EVQLLESGGG LVQPGGSLRL SCAASGFTFS PYPMIWVRQA PGKGLEWVSY ISSSGGYTDY    60
ADSVKGRFTI SRDNSKNTLY LQMNSLRAED TAVYYCAKDR AYGDYVGWNG FDYWGQGTLV   120
TVSS                                                                124

LC for Fab M301-E12
(SEQ ID NO: 916)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M301-E12
(SEQ ID NO: 917)
EVQLLESGGG LVQPGGSLRL SCAASGFTFS PYPMWVRQA PGKGLEWVSY ISPSGGWTDY     60
ADSVKGRFTI SRDNSKNTLY LQMNSLRAED TAVYYCAKDR AYGDYVGWNG FDYWGQGTLV   120
TVSS                                                                124

LC for Fab M271-C03
(SEQ ID NO: 918)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK                108

HC for Fab M271-C03
(SEQ ID NO: 919)
EVQLLESGGG LVQPGGSLRL SCAASGFTFS PYPMWVRQA PGKGLEWVSY IVPSGGKTFY     60
ADSVKGRFTI SRDNSKNTLY LQMNSLRAED TAVYYCAKDR AYGDYVGWNG FDYWGQGTLV   120
TVSS                                                                124

```
LC for Fab M274-C08
                                                  (SEQ ID NO: 920)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M274-C08
                                                  (SEQ ID NO: 921)
EVQLLESGGG LVQPGGSLRL SCAASGFTFS QYAMIWVRQA PGKGLEWVSY ISPSGGYTGY        60
ADSVKGRFTI SRDNSKNTLY LQMNSLRAED TAVYYCAKDR AYGDYVGWNG FDYWGQGTLV       120
TVSS                                                                    124

LC for Fab M274-G04
                                                  (SEQ ID NO: 922)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M274-G04
                                                  (SEQ ID NO: 923)
EVQLLESGGG LVQPGGSLRL SCAASGFTFS QYDMIWVRQA PGKGLEWVSY IGSSGGSTIY        60
ADSVKGRFTI SRDNSKNTLY LQMNSLRAED TAVYYCAKDR AYGDYVGWNG FDYWGQGTLV       120
TVSS                                                                    124

LC for Fab M274-B05
                                                  (SEQ ID NO: 924)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M274-B05
                                                  (SEQ ID NO: 925)
EVQLLESGGG LVQPGGSLRL SCAASGFTFS QYDMWWFRQA PGKGLEWVSV ISPSGGHTSY        60
ADSVKGRFTI SRDNSKNTLY LQMNSLRAED TAVYYCAKDR AYGDYVGWNG FDYWGQGTLV       120
TVSS                                                                    124

LC for Fab M270-D11
                                                  (SEQ ID NO: 926)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M270-D11
                                                  (SEQ ID NO: 927)
EVQLLESGGG LVQPGGSLRL SCAASGFTFS QYDMWWVRQA PGKGLEWVSV ISSSGGATWY        60
ADSVKGRFTI SRDNSKNTLY LQMNSLRAED TAVYYCAKDR AYGDYVGWNG FDYWGQGTLV       120
TVSS                                                                    124

LC for Fab M276-A01
                                                  (SEQ ID NO: 928)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M276-A01
                                                  (SEQ ID NO: 929)
EVQLLESGGG LVQPGGSLRL SCAASGFTFS QYDMWWVRQA PGKGLEWVSV IYPSGGPTFY        60
ADSVKGRFTI SRDNSKNTLY LQMNSLRAED TAVYYCAKDR AYGDYVGWNG FDYWGQGTLV       120
TVSS                                                                    124

LC for Fab M269-F11
                                                  (SEQ ID NO: 930)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M269-F11
                                                  (SEQ ID NO: 931)
EVQLLESGGG LVQPGGSLRL SCAASGFTFS QYDMWWVRQA PGKGLEWVSV IYPSGGTTFY        60
ADSVKGRFTI SRDNSKNTLY LQMNSLRAED TAVYYCAKDR AYGDYVGWNG FDYWGQGTLV       120
TVSS                                                                    124

LC for Fab M276-B07
                                                  (SEQ ID NO: 932)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                    108

HC for Fab M276-B07
                                                  (SEQ ID NO: 933)
EVQLLESGGG LVQPGGSLRL SCAASGFTFS QYDMWWVRQA PGKGLEWVSV IYPSGGYTDY        60
ADSVKGRFTI SRDNSKNTLY LQMNSLRAED TAVYYCAKDR AYGDYVGWNG FDYWGQGTLV       120
TVSS                                                                    124
```

```
LC for Fab M275-D03
                                                  (SEQ ID NO: 934)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M275-D03
                                                  (SEQ ID NO: 935)
EVQLLESGGG LVQPGGSLRL SCAASGFTFS QYDMWWVRQA PGKGLEWVSV IYPSGTTFYA      60
DSVKGRFTIS RDNSKNTLYL QMNSLRAEDT AVYYCAKDRA YGDYVGWNGF DYWGQGTLVT     120
VSS                                                                  123

LC for Fab M268-F07
                                                  (SEQ ID NO: 936)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M268-F07
                                                  (SEQ ID NO: 937)
EVQLLESGGG LVQPGGSLRL SCAASGFTFS QYDMWWVRQA PGKGLEWVSY IVPSGGFTDY      60
ADSVKGRFTI SRDNSKNTLY LQMNSLRAED TAVYYCAKDR AYGDYVGWNG FDWGQGTLV     120
TVSS                                                                 124

LC for Fab M268-H01
                                                  (SEQ ID NO: 938)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M268-H01
                                                  (SEQ ID NO: 939)
EVQLLESGGG LVQPGGSLRL SCAASGFTFS QYGMWWVRQA PGKGLEWVSY IYPSGGGTYY      60
ADSVKGRFTI SRDNSKNTLY LQMNSLRAED TAVYYCAKDR AYGDYVGWNG FDWGQGTLV     120
TVSS                                                                 124

LC for Fab M271-B11
                                                  (SEQ ID NO: 940)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M271-B11
                                                  (SEQ ID NO: 941)
EVQLLESGGG LVQPGGSLRL SCAASGFTFS QYMMIWVRQA PGKGLEWVSY IVPSGGTTGY      60
ADSVKGRFTI SRDNSKNTLY LQMNSLRAED TAVYYCAKDR AYGDYVGWNG FDWGQGTLV     120
TVSS                                                                 124

LC for Fab M270-H12
                                                  (SEQ ID NO: 942)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M270-H12
                                                  (SEQ ID NO: 943)
EVQLLESGGG LVQPGGSLRL SCAASGFTFS QYPMFWVRQA PGKGLEWVSY IVPSGGYTSY      60
ADSVKGRFTI SRDNSKNTLY LQMNSLRAED TAVYYCAKDR AYGDYVGWNG FDWGQGTLV     120
TVSS                                                                 124

LC for Fab M273-C06
                                                  (SEQ ID NO: 944)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M273-C06
                                                  (SEQ ID NO: 945)
EVQLLESGGG LVQPGGSLRL SCAASGFTFS QYPMIWVRQA PGKGLEWVSY IVPSGGWTSY      60
ADSVKGRFTI SRDNSKNTLY LQMNSLRAED TAVYYCAKDR AYGDYVGWNG FDWGQGTLV     120
TVSS                                                                 124

LC for Fab M277-F05
                                                  (SEQ ID NO: 946)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M277-F05
                                                  (SEQ ID NO: 947)
EVQLLESGGG LVQPGGSLRL SCAASGFTFS QYPMMWVRQA PGKGLEWVSY IYPSGGATYY      60
ADSVKGRFTI SRDNSKNTLY LQMNSLRAED TAVYYCAKDR AYGDYVGWNG FDWGQGTLV     120
TVSS                                                                 124
```

```
LC for Fab M273-C12
                                                         (SEQ ID NO: 948)
QDIQMTQSPA TLSLSPGERA TLSCRASQSI SSFLAWYQQK PGQAPRLLIY DASYRATGIP         60
ARFSGSGSGT DFTLTISSLE PEDYAVYYCQ QRGNWPITFG QGTRLEIK                    108

HC for Fab M273-C12
                                                         (SEQ ID NO: 949)
EVQLLESGGG LVQPGGSLRL SCAASGFTFS QYPMMWVRQA PGKGLEWVSY IYPSGGGTYY         60
ADSVKGRFTI SRDNSKNTLY LQMNSLRAED TAVYYCAKDR AYGDYVGWNG FDYWGQGTLV        120
TVSS                                                                    124

LC for Fab M275-F11
                                                         (SEQ ID NO: 950)
QDIQMTQSPA TLSLSPGERA TLSCRASQSI SSFLAWYQQK PGQAPRLLIY DASYRATGIP         60
ARFSGSGSGT DFTLTISSLE PEDYAVYYCQ QRGNWPITFG QGTRLEIK                    108

HC for Fab M275-F11
                                                         (SEQ ID NO: 951)
EVQLLESGGG LVQPGGSLRL SCAASGFTFS QYPMWWVRQA PGKGLEWVSS ISPSGGATYY         60
ADSVKGRFTI SRDNSKNTLY LQMNSLRAED TAVYYCAKDR AYGDYVGWNG FDYWGQGTLV        120
TVSS                                                                    124

LC for Fab M268-C02
                                                         (SEQ ID NO: 952)
QDIQMTQSPA TLSLSPGERA TLSCRASQSI SSFLAWYQQK PGQAPRLLIY DASYRATGIP         60
ARFSGSGSGT DFTLTISSLE PEDYAVYYCQ QRGNWPITFG QGTRLEIK                    108

HC for Fab M268-C02
                                                         (SEQ ID NO: 953)
EVQLLESGGG LVQPGGSLRL SCAASGFTFS QYPMWWVRQA PGKGLEWVSS IYPSGGGTFY         60
ADSVKGRFTI SRDNSKNTLY LQMNSLRAED TAVYYCAKDR AYGDYVGWNG FDYWGQGTLV        120
TVSS                                                                    124

LC for Fab M269-D01
                                                         (SEQ ID NO: 954)
QDIQMTQSPA TLSLSPGERA TLSCRASQSI SSFLAWYQQK PGQAPRLLIY DASYRATGIP         60
ARFSGSGSGT DFTLTISSLE PEDYAVYYCQ QRGNWPITFG QGTRLEIK                    108

HC for Fab M269-D01
                                                         (SEQ ID NO: 955)
EVQLLESGGG LVQPGGSLRL SCAASGFTFS QYPMWWVRQA PGKGLEWVSS IYSSGGATYY         60
ADSVKGRFTI SRDNSKNTLY LQMNSLRAED TAVYYCAKDR AYGDYVGWNG FDYWGQGTLV        120
TVSS                                                                    124

LC for Fab M270-C06
                                                         (SEQ ID NO: 956)
QDIQMTQSPA TLSLSPGERA TLSCRASQSI SSFLAWYQQK PGQAPRLLIY DASYRATGIP         60
ARFSGSGSGT DFTLTISSLE PEDYAVYYCQ QRGNWPITFG QGTRLEIK                    108

HC for Fab M270-C06
                                                         (SEQ ID NO: 957)
EVQLLESGGG LVQPGGSLRL SCAASGFTFS QYPMWWVRQA PGKGLEWVSV IYPSGGFTSY         60
ADSVKGRFTI SRDNSKNTLY LQMNSLRAED TAVYYCAKDR AYGDYVGWNG FDYWGQGTLV        120
TVSS                                                                    124

LC for Fab M270-D09
                                                         (SEQ ID NO: 958)
QDIQMTQSPA TLSLSPGERA TLSCRASQSI SSFLAWYQQK PGQAPRLLIY DASYRATGIP         60
ARFSGSGSGT DFTLTISSLE PEDYAVYYCQ QRGNWPITFG QGTRLEIK                    108

HC for Fab M270-D09
                                                         (SEQ ID NO: 959)
EVQLLESGGG LVQPGGSLRL SCAASGFTFS QYPMWWVRQA PGKGLEWVSV IYPSGGYTGY         60
ADSVKGRFTI SRDNSKNTLY LQMNSLRAED TAVYYCAKDR AYGDYVGWNG FDYWGQGTLV        120
TVSS                                                                    124

LC for Fab M275-F07
                                                         (SEQ ID NO: 960)
QDIQMTQSPA TLSLSPGERA TLSCRASQSI SSFLAWYQQK PGQAPRLLIY DASYRATGIP         60
ARFSGSGSGT DFTLTISSLE PEDYAVYYCQ QRGNWPITFG QGTRLEIK                    108

HC for Fab M275-F07
                                                         (SEQ ID NO: 961)
EVQLLESGGG LVQPGGSLRL SCAASGFTFS QYQMWWVRQA PGKGLEWVSV IYPSGGATYY         60
ADSVKGRFTI SRDNSKNTLY LQMNSLRAED TAVYYCAKDR AYGDYVGWNG FDYWGQGTLV        120
TVSS                                                                    124
```

LC for Fab M277-D10
(SEQ ID NO: 962)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M277-D10
(SEQ ID NO: 963)
```
EVQLLESGGG LVQPGGSLRL SCAASGFTFS QYSMIWVRQA PGKGLEWVSY IVPSGGYTSY      60
ADSVKGRFTI SRDNSKNTLY LQMNSLRAED TAVYYCAKDR AYGDYVGWNG FDYWGQGTLV    120
TVSS                                                                 124
```

LC for Fab M275-E02
(SEQ ID NO: 964)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M275-E02
(SEQ ID NO: 965)
```
EVQLLESGGG LVQPGGSLRL SCAASGFTFS QYSMWWVRQA PGKGLEWVSS IVPSGGATFY      60
ADSVKGRFTI SRDNSKNTLY LQMNSLRAED TAVYYCAKDR AYGDYVGWNG FDYWGQGTLV    120
TVSS                                                                 124
```

LC for Fab M274-H10
(SEQ ID NO: 966)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M274-H10
(SEQ ID NO: 967)
```
EVQLLESGGG LVQPGGSLRL SCAASGFTFS QYSMWWVRQA PGKGLEWVSV IYSSGGATFY      60
ADSVKGRFTI SRDNSKNTLY LQMNSLRAED TAVYYCAKDR AYGDYVGWNG FDYWGQGTLV    120
TVSS                                                                 124
```

LC for Fab M271-C06
(SEQ ID NO: 968)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M271-C06
(SEQ ID NO: 969)
```
EVQLLESGGG LVQPGGSLRL SCAASGFTFS QYSMWWVRQA PGKGLEWVSV IYSSGSATFY      60
ADSVKGRFTI SRDNSKNTLY LQMNSLRAED TAVYYCAKDR AYGDYVGWNG FDYWGQGTLV    120
TVSS                                                                 124
```

LC for Fab M272-C06
(SEQ ID NO: 970)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M272-C06
(SEQ ID NO: 971)
```
EVQLLESGGG LVQPGGSLRL SCAASGFTFS QYWMWWVRQA PGKGLEWVSV ISSSGGGTYY      60
ADSVKGRFTI SRDNSKNTLY LQMNSLRAED TAVYYCAKDR AYGDYVGWNG FDYWGQGTLV    120
TVSS                                                                 124
```

LC for Fab M274-C02
(SEQ ID NO: 972)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M274-C02
(SEQ ID NO: 973)
```
EVQLLESGGG LVQPGGSLRL SCAASGFTFS QYWMWWVRQA PGKGLEWVSV IVPSGGKTFY      60
ADSVKGRFTI SRDNSKNTLY LQMNSLRAED TAVYYCAKDR AYGDYVGWNG FDYWGQGTLV    120
TVSS                                                                 124
```

LC for Fab M274-G01
(SEQ ID NO: 974)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M274-G01
(SEQ ID NO: 975)
```
EVQLLESGGG LVQPGGSLRL SCAASGFTFS RYAMIWVRQA PGKGLEWVSY ISPSGGFTDY      60
ADSVKGRFTI SRDNSKNTLY LQMNSLRAED TAVYYCAKDR AYGDYVGWNG FDYWGQGTLV    120
TVSS                                                                 124
```

```
LC for Fab M268-F12
                                                     (SEQ ID NO: 976)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                   108

HC for Fab M268-F12
                                                     (SEQ ID NO: 977)
EVQLLESGGG LVQPGGSLRL SCAASGFTFS RYAMMWVRQA PGKGLEWVSY ISPSGGFTDY       60
ADSVKGRFTI SRDNSKNTLY LQMNSLRAED TAVYYCAKDR AYGDYVGWNG FDYWGQGTLV      120
TVSS                                                                   124

LC for Fab M268-F11
                                                     (SEQ ID NO: 978)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                   108

HC for Fab M268-F11
                                                     (SEQ ID NO: 979)
EVQLLESGGG LVQPGGSLRL SCAASGFTFS RYAMWWVRQA PGKGLEWVSS IYPSGGGTFY       60
ADSVKGRFTI SRDNSKNTLY LQMNSLRAED TAVYYCAKDR AYGDYVGWNG FDYWGQGTLV      120
TVSS                                                                   124

LC for Fab M299-E06
                                                     (SEQ ID NO: 980)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                   108

HC for Fab M299-E06
                                                     (SEQ ID NO: 981)
EVQLLESGGG LVQPGGSLRL SCAASGFTFS RYAMWWVRQA PGKGLEWVSY IVPSGGYTDY       60
ADSVKGRFTI SRDNSKNTLY LQMNSLRAED TAVYYCAKDR AYGDYVGWNG FDYWGQGTLV      120
TVSS                                                                   124

LC for Fab M273-B12
                                                     (SEQ ID NO: 982)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                   108

HC for Fab M273-B12
                                                     (SEQ ID NO: 983)
EVQLLESGGG LVQPGGSLRL SCAASGFTFS RYDMFWVRQA PGKGLEWVSS ISPSGGGTYY       60
ADSVKGRFTI SRDNSKNTLY LQMNSLRAED TAVYYCAKDR AYGDYVGWNG FDYWGQGTLV      120
TVSS                                                                   124

LC for Fab M298-A04
                                                     (SEQ ID NO: 984)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                   108

HC for Fab M298-A04
                                                     (SEQ ID NO: 985)
EVQLLESGGG LVQPGGSLRL SCAASGFTFS RYDMWWVRQA PGKGLEWVSS ISSSGGFTGY       60
ADSVKGRFTI SRDNSKNTLY LQMNSLRAED TAVYYCAKDR AYGDYVGWNG FDYWGQGTLV      120
TVSS                                                                   124

LC for Fab M273-A11
                                                     (SEQ ID NO: 986)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                   108

HC for Fab M273-A11
                                                     (SEQ ID NO: 987)
EVQLLESGGG LVQPGGSLRL SCAASGFTFS RYDMWWVRQA PGKGLEWVSV ISPSGGATFY       60
ADSVKGRFTI SRDNSKNTLY LQMNSLRAED TAVYYCAKDR AYGDYVGWNG FDYWGQGTLV      120
TVSS                                                                   124

LC for Fab M269-A05
                                                     (SEQ ID NO: 988)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                   108

HC for Fab M269-A05
                                                     (SEQ ID NO: 989)
EVQLLESGGG LVQPGGSLRL SCAASGFTFS RYDMWWVRQA PGKGLEWVSV IYPSGGHTMY       60
ADSVKGRFTI SRDNSKNTLY LQMNSLRAED TAVYYCAKDR AYGDYVGWNG FDYWGQGTLV      120
TVSS                                                                   124
```

```
LC for Fab M270-C05
                                                    (SEQ ID NO: 990)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M270-C05
                                                    (SEQ ID NO: 991)
EVQLLESGGG LVQPGGSLRL SCAASGFTFS RYDMWWVRQA PGKGLEWVSW ISPSGGGTQY     60
ADSVKGRFTI SRDNSKNTLY LQMNSLRAED TAVYYCAKDR AYGDYVGWNG FDYWGQGTLV   120
TVSS                                                                124

LC for Fab M269-F05
                                                    (SEQ ID NO: 992)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-F05
                                                    (SEQ ID NO: 993)
EVQLLESGGG LVQPGGSLRL SCAASGFTFS RYDMWWVRQA PGKGLEWVSY IVPSGGFTSY     60
ADSVKGRFTI SRDNSKNTLY LQMNSLRAED TAVYYCAKDR AYGDYVGWNG FDYWGQGTVL   120
TVSS                                                                124

LC for Fab M277-H07
                                                    (SEQ ID NO: 994)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M277-H07
                                                    (SEQ ID NO: 995)
EVQLLESGGG LVQPGGSLRL SCAASGFTFS RYHMWWVRQA PGKGLEWVSY ISPSGGSTLY     60
ADSVKGRFTI SRDNSKNTLY LQMNSLRAED TAVYYCAKDR AYGDYVGWNG FDYWGQGTLV   120
TVSS                                                                124

LC for Fab M275-A06
                                                    (SEQ ID NO: 996)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M275-A06
                                                    (SEQ ID NO: 997)
EVQLLESGGG LVQPGGSLRL SCAASGFTFS RYMMIWVRQA PGKGLEWVSG IYPSGGWTDY     60
ADSVKGRFTI SRDNSKNTLY LQMNSLRAED TAVYYCAKDR AYGDYVGWNG FDYWGQGTLV   120
TVSS                                                                124

LC for Fab M268-B10
                                                    (SEQ ID NO: 998)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M268-B10
                                                    (SEQ ID NO: 999)
EVQLLESGGG LVQPGGSLRL SCAASGFTFS RYNMWWVRQA PGKGLEWVSV IYPSGGATYY     60
ADSVKGRFTI SRDNSKNTLY LQMNSLRAED TAVYYCAKDR AYGDYVGWNG FDYWGQGTLV   120
TVSS                                                                124

LC for Fab M270-H03
                                                   (SEQ ID NO: 1000)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M270-H03
                                                   (SEQ ID NO: 1001)
EVQLLESGGG LVQPGGSLRL SCAASGFTFS RYPMFWVRQA PGKGLEWVSY ISPSGGYTSY     60
ADSVKGRFTI SRDNSKNTLY LQMNSLRAED TAVYYCAKDR AYGDYVGWNG FDYWGQGTLV   120
TVSS                                                                124

LC for Fab M276-A02
                                                   (SEQ ID NO: 1002)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M276-A02
                                                   (SEQ ID NO: 1003)
EVQLLESGGG LVQPGGSLRL SCAASGFTFS RYPMFWVRQA PGKGLEWVSY IVPSGGYTDY     60
ADSVKGRFTI SRDNSKNTLY LQMNSLRAED TAVYYCAKDR AYGDYVGWNG FDYWGQGTLV   120
TVSS                                                                124
```

```
LC for Fab M304-C09
                                                         (SEQ ID NO: 1004)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M304-C09
                                                         (SEQ ID NO: 1005)
EVQLLESGGG LVQPGGSLRL SCAASGFTFS RYPMIWVRQA PGKGLEWVSY IYPSGGGTYY      60
ADSVKGRFTI SRDNSKNTLY LQMNSLRAED TAVYYCAKDR AYGDYVGWNG FDYWGQGTLV    120
TVSS                                                                 124

LC for Fab M271-B05
                                                         (SEQ ID NO: 1006)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M271-B05
                                                         (SEQ ID NO: 1007)
EVQLLESGGG LVQPGGSLRL SCAASGFTFS RYPMVWVRQA PGKGLEWVSY ISPSGGYTGY      60
ADSVKGRFTI SRDNSKNTLY LQMNSLRAED TAVYYCAKDR AYGDYVGWNG FDYWGQGTLV    120
TVSS                                                                 124

LC for Fab M270-C04
                                                         (SEQ ID NO: 1008)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M270-C04
                                                         (SEQ ID NO: 1009)
EVQLLESGGG LVQPGGSLRL SCAASGFTFS RYPMWWVRQA PGKGLEWVSS ISSSGGGTYY      60
ADSVKGRFTI SRDNSKNTLY LQMNSLRAED TAVYYCAKDR AYGDYVGWNG FDYWGQGTLV    120
TVSS                                                                 124

LC for Fab M268-G08
                                                         (SEQ ID NO: 1010)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M268-G08
                                                         (SEQ ID NO: 1011)
EVQLLESGGG LVQPGGSLRL SCAASGFTFS RYPMWWVRQA PGKGLEWVSS IYPSGGATFY      60
ADSVKGRFTI SRDNSKNTLY LQMNSLRAED TAVYYCAKDR AYGDYVGWNG FDYWGQGTLV    120
TVSS                                                                 124

LC for Fab M269-E08
                                                         (SEQ ID NO: 1012)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M269-E08
                                                         (SEQ ID NO: 1013)
EVQLLESGGG LVQPGGSLRL SCAASGFTFS RYPMWWVRQA PGKGLEWVSV IYPSGGATYY      60
ADSVKGRFTI SRDNSKNTLY LQMNSLRAED TAVYYCAKDR AYGDYVGWNG FDYWGQGTLV    120
TVSS                                                                 124

LC for Fab M276-F02
                                                         (SEQ ID NO: 1014)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M276-F02
                                                         (SEQ ID NO: 1015)
EVQLLESGGG LVQPGGSLRL SCAASGFTFS RYPMWWVRQA PGKGLEWVSV IYPSGGTTFY      60
ADSVKGRFTI SRDNSKNTLY LQMNSLRAED TAVYYCAKDR AYGDYVGWNG FDYWGQGTLV    120
TVSS                                                                 124

LC for Fab M276-A10
                                                         (SEQ ID NO: 1016)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M276-A10
                                                         (SEQ ID NO: 1017)
EVQLLESGGG LVQPGGSLRL SCAASGFTFS RYPMWWVRQA PGKGLEWVSV IYSSGGYTGY      60
ADSVKGRFTI SRDNSKNTLY LQMNSLRAED TAVYYCAKDR AYGDYVGWNG FDYWGQGTLV    120
TVSS                                                                 124
```

```
LC for Fab M304-D03
                                                        (SEQ ID NO: 1018)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M304-D03
                                                        (SEQ ID NO: 1019)
EVQLLESGGG LVQPGGSLRL SCAASGFTFS RYPMWWVRQA PGKGLEWVSY IGSSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M271-D11
                                                        (SEQ ID NO: 1020)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M271-D11
                                                        (SEQ ID NO: 1021)
EVQLLESGGG LVQPGGSLRL SCAASGFTFS RYPMWWVRQA PGKGLEWVSY ISPSGGGTLY      60
ADSVKGRFTI SRDNSKNTLY LQMNSLRAED TAVYYCAKDR AYGDYVGWNG FDYWGQGTLV     120
TVSS                                                                  124

LC for Fab M272-A08
                                                        (SEQ ID NO: 1022)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M272-A08
                                                        (SEQ ID NO: 1023)
EVQLLESGGG LVQPGGSLRL SCAASGFTFS RYPMWWVRQA PGKGLEWVSY ISPSGGMTSY      60
ADSVKGRFTI SRDNSKNTLY LQMNSLRAED TAVYYCAKDR AYGDYVGWNG FDYWGQGTLV     120
TVSS                                                                  124

LC for Fab M269-B07
                                                        (SEQ ID NO: 1024)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M269-B07
                                                        (SEQ ID NO: 1025)
EVQLLESGGG LVQPGGSLRL SCAASGFTFS RYPMWWVRQA PGKGLEWVSY ISSSGGGTFY      60
ADSVKGRFTI SRDNSKNTLY LQMNSLRAED TAVYYCAKDR AYGDYVGWNG FDYWGQGTLV     120
TVSS                                                                  124

LC for Fab M271-G08
                                                        (SEQ ID NO: 1026)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M271-G08
                                                        (SEQ ID NO: 1027)
EVQLLESGGG LVQPGGSLRL SCAASGFTFS RYPMWWVRQA PGKGLEWVSY ISSSGGGTLY      60
ADSVKGRFTI SRDNSKNTLY LQMNSLRAED TAVYYCAKDR AYGDYVGWNG FDYWGQGTLV     120
TVSS                                                                  124

LC for Fab M271-A02
                                                        (SEQ ID NO: 1028)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M271-A02
                                                        (SEQ ID NO: 1029)
EVQLLESGGG LVQPGGSLRL SCAASGFTFS RYPMWWVRQA PGKGLEWVSY IVPSGGATYY      60
ADSVKGRFTI SRDNSKNTLY LQMNSLRAED TAVYYCAKDR AYGDYVGWNG FDYWGQGTLV     120
TVSS                                                                  124

LC for Fab M273-G11
                                                        (SEQ ID NO: 1030)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M273-G11
                                                        (SEQ ID NO: 1031)
EVQLLESGGG LVQPGGSLRL SCAASGFTFS RYPMWWVRQA PGKGLEWVSY IVPSGGFTDY      60
AHSVKGRFTI SRDNSKNTLY LQMNSLRAED TAVYYCAKDR AYGDYVGWNG FDYWGQGTLV     120
TVSS                                                                  124
```

```
LC for Fab M299-B04
                                                        (SEQ ID NO: 1032)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M299-B04
                                                        (SEQ ID NO: 1033)
EVQLLESGGG LVQPGGSLRL SCAASGFTFS RYPMWWVRQA PGKGLEWVSY IVPSGGTTYY      60
ADSVKGRFTI SRDNSKNTLY LQMNSLRAED TAVYYCAKDR AYGDYVGWNG FDYWGQGTLV    120
TVSS                                                                124

LC for Fab M275-E08
                                                        (SEQ ID NO: 1034)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M275-E08
                                                        (SEQ ID NO: 1035)
EVQLLESGGG LVQPGGSLRL SCAASGFTFS RYPMWWVRQA PGKGLEWVSY IYPSGGATFY      60
ADSVKGRFTI SRDNSKNTLY LQMNSLRAED TAVYYCAKDR AYGDYVGWNG FDYWGQGTLV    120
TVSS                                                                124

LC for Fab M275-B08
                                                        (SEQ ID NO: 1036)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M275-B08
                                                        (SEQ ID NO: 1037)
EVQLLESGGG LVQPGGSLRL SCAASGFTFS RYPMWWVRQA PGKGLEWVSY IYSSGGKTFY      60
ADSVKGRFTI SRDNSKNTLY LQMNSLRAED TAVYYCAKDR AYGDYVGWNG FDYWGQGTLV    120
TVSS                                                                124

LC for Fab M277-G09
                                                        (SEQ ID NO: 1038)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M277-G09
                                                        (SEQ ID NO: 1039)
EVQLLESGGG LVQPGGSLRL SCAASGFTFS RYSMWWVRQA PGKGLEWVSS IYPSGGATFY      60
ADSVKGRFTI SRDNSKNTLY LQMNSLRAED TAVYYCAKDR AYGDYVGWNG FDYWGQGTLV    120
TVSS                                                                124

LC for Fab M271-E01
                                                        (SEQ ID NO: 1040)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M271-E01
                                                        (SEQ ID NO: 1041)
EVQLLESGGG LVQPGGSLRL SCAASGFTFS RYSMWWVRQA PGKGLEWVSV IYPSGGYTGY      60
ADSVKGRFTI SRDNSKNTLY LQMNSLRAED TAVYYCAKDR AYGDYVGWNG FDYWGQGTLV    120
TVSS                                                                124

LC for Fab M275-F09
                                                        (SEQ ID NO: 1042)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M275-F09
                                                        (SEQ ID NO: 1043)
EVQLLESGGG LVQPGGSLRL SCAASGFTFS RYWMWWVRQA PGKGLEWVSV IVPSGGATFY      60
ADSVKGRFTI SRDNSKNTLY LQMNSLRAED TAVYYCAKDR AYGDYVGWNG FDYWGQGTLV    120
TVSS                                                                124

LC for Fab M269-D08
                                                        (SEQ ID NO: 1044)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M269-D08
                                                        (SEQ ID NO: 1045)
EVQLLESGGG LVQPGGSLRL SCAASGFTFS RYYMWWVRQA PGKGLEWVSY ISPSGGATYY      60
ADSVKGRFTI SRDNSKNTLY LQMNSLRAED TAVYYCAKDR AYGDYVGWNG FDYWGQGTLV    120
TVSS                                                                124
```

```
LC for Fab M277-C12
                                                    (SEQ ID NO: 1046)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M277-C12
                                                    (SEQ ID NO: 1047)
EVQLLESGGG LVQPGGSLRL SCAASGFTFS SYDMIWVRQA PGKGLEWVSW IGPSGGSTMY     60
ADSVKGRFTI SRDNSKNTLY LQMNSLRAED TAVYYCAKDR AYGDYVGWNG FDYWGQGTLV    120
TVSS                                                                 124

LC for Fab M274-F12
                                                    (SEQ ID NO: 1048)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M274-F12
                                                    (SEQ ID NO: 1049)
EVQLLESGGG LVQPGGSLRL SCAASGFTFS SYDMWWVRQA PGKGLEWVSS ISSSVGATYY     60
ADSVKGRFTI SRDNSKNTLY LQMNSLRAED TAVYYCAKDR AYGDYVGWNG FDYWGQGTLV    120
TVSS                                                                 124

LC for Fab M269-G01
                                                    (SEQ ID NO: 1050)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-G01
                                                    (SEQ ID NO: 1051)
EVQLLESGGG LVQPGGSLRL SCAASGFTFS SYDMWWVRQA PGKGLEWVSV IGPSGGGTFY     60
ADSVKGRFTI SRDNSKNTLY LQMNSLRAED TAVYYCAKDR AYGDYVGWNG FDYWGQGTLV    120
TVSS                                                                 124

LC for Fab M269-F04
                                                    (SEQ ID NO: 1052)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-F04
                                                    (SEQ ID NO: 1053)
EVQLLESGGG LVQPGGSLRL SCAASGFTFS SYDMWWVRQA PGKGLEWVSV ISPSGGYTGY     60
ADSVKGRFTI SRDNSKNTLY LQMNSLRAED TAVYYCAKDR AYGDYVGWNG FDYWGQGTLV    120
TVSS                                                                 124

LC for Fab M269-E01
                                                    (SEQ ID NO: 1054)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-E01
                                                    (SEQ ID NO: 1055)
EVQLLESGGG LVQPGGSLRL SCAASGFTFS SYDMWWVRQA PGKGLEWVSV IYPSGGRTYY     60
ADSVKGRFTI SRDNSKNTLY LQMNSLRAED TAVYYCAKDR AYGDYVGWNG FDYWGQGTLV    120
TVSS                                                                 124

LC for Fab M269-G07
                                                    (SEQ ID NO: 1056)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M269-G07
                                                    (SEQ ID NO: 1057)
EVQLLESGGG LVQPGGSLRL SCAASGFTFS SYDMWWVRQA PGKGLEWVSV IYSSGGFTGY     60
ADSVKGRFTI SRDNSKNTLY LQMNSLRAED TAVYYCAKDR AYGDYVGWNG FDYWGQGTLV    120
TVSS                                                                 124

LC for Fab M268-C01
                                                    (SEQ ID NO: 1058)
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                 108

HC for Fab M268-C01
                                                    (SEQ ID NO: 1059)
EVQLLESGGG LVQPGGSLRL SCAASGFTFS SYDMWWVRQA PGKGLEWVSV IYSSGGTTFY     60
ADSVKGRFTI SRDNSKNTLY LQMNSLRAED TAVYYCAKDR AYGDYVGWNG FDYWGQGTLV    120
TVSS                                                                 124
```

LC for Fab M268-D06

(SEQ ID NO: 1060)

```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M268-D06

(SEQ ID NO: 1061)

```
EVQLLESGGG LVQPGGSLRL SCAASGFTFS SYDMWWVRQA PGKGLEWVSV IYSSGGYTGY     60
ADSVKGRFTI SRDNSKNTLY LQMNSLRAED TAVYYCAKDR AYGDYVGWNG FDYWGQGTLV    120
TVSS                                                                124
```

LC for Fab M272-G07

(SEQ ID NO: 1062)

```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M272-G07

(SEQ ID NO: 1063)

```
EVQLLESGGG LVQPGGSLRL SCAASGFTFS SYEMWWVRQA PGKGLEWVSV IYSSGGATFY     60
ADSVKGRFTI SRDNSKNTLY LQMNSLRAED TAVYYCAKDR AYGDYVGWNG FDYWGQGTLV    120
TVSS                                                                124
```

LC for Fab M303-F07

(SEQ ID NO: 1064)

```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M303-F07

(SEQ ID NO: 1065)

```
EVQLLESGGG LVQPGGSLRL SCAASGFTFS SYEMWWVRQA PGKGLEWVSY ISSSGGGTYY     60
ADSVKGRFTI SRDNSKNTLY LQMNSLRAED TAVYYCAKDR AYGDYVGWNG FDYWGQGTLV    120
TVSS                                                                124
```

LC for Fab M275-B02

(SEQ ID NO: 1066)

```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M275-B02

(SEQ ID NO: 1067)

```
EVQLLESGGG LVQPGGSLRL SCAASGFTFS SYMMIWVRQA PGKGLEWVSS ISPSGGGTYY     60
ADSVKGRFTI SRDNSKNTLY LQMNSLRAED TAVYYCAKDR AYGDYVGWNG FDYWGQGTLV    120
TVSS                                                                124
```

LC for Fab M269-C01

(SEQ ID NO: 1068)

```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M269-C01

(SEQ ID NO: 1069)

```
EVQLLESGGG LVQPGGSLRL SCAASGFTFS SYMMIWVRQA PGKGLEWVSS ISPSGGWTSY     60
ADSVKGRFTI SRDNSKNTLY LQMNSLRAED TAVYYCAKDR AYGDYVGWNG FDYWGQGTLV    120
TVSS                                                                124
```

LC for Fab M268-H04

(SEQ ID NO: 1070)

```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M268-H04

(SEQ ID NO: 1071)

```
EVQLLESGGG LVQPGGSLRL SCAASGFTFS SYMMIWVRQA PGKGLEWVSS IYPSGGYTSY     60
ADSVKGRFTI SRDNSKNTLY LQMNSLRAED TAVYYCAKDR AYGDYVGWNG FDYWGQGTLV    120
TVSS                                                                124
```

LC for Fab M277-H08

(SEQ ID NO: 1072)

```
QDIQMTQSPA TLSLSPGERA TLSCRASQSI SSFLAWYQQK PGQAPRLLIY DASYRATGIP     60
ARFSGSGSGT DFTLTISSLE PEDYAVYYCQ QRGNWPITFG QGTRLEIK                108
```

HC for Fab M277-H08

(SEQ ID NO: 1073)

```
EVQLLESGGG LVQPGGSLRL SCAASGFTFS SYNMWWVRQA PGKGLEWVSS ISPSGGGTYY     60
ADSVKGRFTI SRDNSKNTLY LQMNSLRAED TAVYYCAKDR AYGDYVGWNG FDYWGQGTLV    120
TVSS                                                                124
```

```
LC for Fab M274-B02
                                                         (SEQ ID NO: 1074)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108

HC for Fab M274-B02
                                                         (SEQ ID NO: 1075)
EVQLLESGGG LVQPGGSLRL SCAASGFTFS SYPMIWVRQA PGKGLEWVSY ISSSGGFTDY        60
ADSVKGRFTI SRDNSKNTLY LQMNSLRAED TAVYYCAKDR AYGDYVGWNG FDYWGQGTLV       120
TVSS                                                                   124

LC for Fab M268-E03
                                                         (SEQ ID NO: 1076)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108

HC for Fab M268-E03
                                                         (SEQ ID NO: 1077)
EVQLLESGGG LVQPGGSLRL SCAASGFTFS SYPMMWVRQA PGKGLEWVSY IYSSGGGTFY        60
ADSVKGRFTI SRDNSKNTLY LQMNSLRAED TAVYYCAKDR AYGDYVGWNG FDYWGQGTLV       120
TVSS                                                                   124

LC for Fab M302-G11
                                                         (SEQ ID NO: 1078)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108

HC for Fab M302-G11
                                                         (SEQ ID NO: 1079)
EVQLLESGGG LVQPGGSLRL SCAASGFTFS SYPMWWVRQA PGKGLEWVSS ISPSGGGTYY        60
ADSVKGRFTI SRDNSKNTLY LQMNSLRAED TAVYYCAKDR AYGDYVGWNG FDYWGQGTLV       120
TVSS                                                                   124

LC for Fab M270-G08
                                                         (SEQ ID NO: 1080)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108

HC for Fab M270-G08
                                                         (SEQ ID NO: 1081)
EVQLLESGGG LVQPGGSLRL SCAASGFTFS SYPMWWVRQA PGKGLEWVSS ISPSGMTYYA        60
DSVKGRFTIS RDNSKNTLYL QMNSLRAEDT AVYYCAKDRA YGDYVGWNGF DYWGQGTLVT       120
VSS                                                                    123

LC for Fab M268-E08
                                                         (SEQ ID NO: 1082)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108

HC for Fab Fab M268-E08
                                                         (SEQ ID NO: 1083)
EVQLLESGGG LVQPGGSLRL SCAASGFTFS SYPMWWVRQA PGKGLEWVSS IYPSGGGTFY        60
ADSVKGRFTI SRDNSKNTLY LQMNSLRAED TAVYYCAKDR AYGDYVGWNG FDYWGQGTLV       120
TVSS                                                                   124

LC for Fab M270-E05
                                                         (SEQ ID NO: 1084)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108

HC for Fab M270-E05
                                                         (SEQ ID NO: 1085)
EVQLLESGGG LVQPGGSLRL SCAASGFTFS SYPMWWVRQA PGKGLEWVSY ISSSGGGTYY        60
ADSVKGRFTI SRDNSKNTLY LQMNSLRAED TAVYYCAKDR AYGDYVGWNG FDYWGQGTLV       120
TVSS                                                                   124

LC for Fab M271-A01
                                                         (SEQ ID NO: 1086)
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108

HC for Fab M271-A01
                                                         (SEQ ID NO: 1087)
EVQLLESGGG LVQPGGSLRL SCAASGFTFS SYPMWWVRQA PGKGLEWVSY IVPSGGATFY        60
ADSVKGRFTI SRDNSKNTLY LQMNSLRAED TAVYYCAKDR AYGDYVGWNG FDYWGQGTLV       120
TVSS                                                                   124
```

```
LC for Fab M270-C03
                                                         (SEQ ID NO: 1088)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M270-C03
                                                         (SEQ ID NO: 1089)
EVQLLESGGG LVQPGGSLRL SCAASGFTFS SYPMWWVRQA PGKGLEWVSY IVPSGGSTLY      60
ADSVKGRFTI SRDNSKNTLY LQMNSLRAED TAVYYCAKDR AYGDYVGWNG FDYWGQGTLV    120
TVSS                                                                 124

LC for Fab M275-A09
                                                         (SEQ ID NO: 1090)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M275-A09
                                                         (SEQ ID NO: 1091)
EVQLLESGGG LVQPGGSLRL SCAASGFTFS SYPMWWVRQA PGKGLEWVSY IVPSGGYTYY      60
ADSVKGRFTI SRDNSKNTLY LQMNSLRAED TAVYYCAKDR AYGDYVGWNG FDYWGQGTLV    120
TVSS                                                                 124

LC for Fab M298-D08
                                                         (SEQ ID NO: 1092)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M298-D08
                                                         (SEQ ID NO: 1093)
EVQLLESGGG LVQPGGSLRL SCAASGFTFS SYQMWWVRQA PGKGLEWVSS IYPSGGATFY      60
ADSVKGRFTI SRDNSKNTLY LQMNSLRAED TAVYYCAKDR AYGDYVGWNG FDYWGQGTLV    120
TVSS                                                                 124

LC for Fab M274-A09
                                                         (SEQ ID NO: 1094)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M274-A09
                                                         (SEQ ID NO: 1095)
EVQLLESGGG LVQPGGSLRL SCAASGFTFS SYSMWWVRQA PGKGLEWVSV IYSSGGYTGY      60
ADSVKGRFTI SRDNSKNTLY LQMNSLRAED TAVYYCAKDR AYGDYVGWNG FDYWGQGTLV    120
TVSS                                                                 124

LC for Fab M269-E06
                                                         (SEQ ID NO: 1096)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M269-E06
                                                         (SEQ ID NO: 1097)
EVQLLESGGG LVQPGGSLRL SCAASGFTFS TYAMIWVRQA PGKGLEWVSY IGPSGGFTDY      60
ADSVKGRFTI SRDNSKNTLY LQMNSLRAED TAVYYCAKDR AYGDYVGWNG FDYWGQGTLV    120
TVSS                                                                 124

LC for Fab M269-H06
                                                         (SEQ ID NO: 1098)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M269-H06
                                                         (SEQ ID NO: 1099)
EVQLLESGGG LVQPGGSLRL SCAASGFTFS TYAMWWVRQA PGKGLEWVSY ISPSGGGTFY      60
ADSVKGRFTI SRDNSKNTLY LQMNSLRAED TAVYYCAKDR AYGDYVGWNG FDYWGQGTLV    120
TVSS                                                                 124

LC for Fab M276-E11
                                                         (SEQ ID NO: 1100)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M276-E11
                                                         (SEQ ID NO: 1101)
EVQLLESGGG LVQPGGSLRL SCAASGFTFS TYDMFWVRQA PGKGLEWVSS ISSSGGATFY      60
ADSVKGRFTI SRDNSKNTLY LQMNSLRAED TAVYYCAKDR AYGDYVGWNG FDYWGQGTLV    120
TVSS                                                                 124
```

-continued

LC for Fab M271-E11
(SEQ ID NO: 1102)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M271-E11
(SEQ ID NO: 1103)
```
EVQLLESGGG LVQPGGSLRL SCAASGFTFS TYDMIWVRQA PGKGLEWVSY ISPSGGYTGY        60
ADSVKGRFTI SRDNSKNTLY LQMNSLRAED TAVYYCAKDR AYGDYVGWNG FDYWGQGTLV       120
TVSS                                                                  124
```

LC for Fab M270-A04
(SEQ ID NO: 1104)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M270-A04
(SEQ ID NO: 1105)
```
EVQLLESGGG LVQPGGSLRL SCAASGFTFS TYDMIWVRQA PGKGLEWVSY ISSSGGFTDY        60
ADSVKGRFTI SRDNSKNTLY LQMNSLRAED TAVYYCAKDR AYGDYVGWNG FDYWGQGTLV       120
TVSS                                                                  124
```

LC for Fab M268-F10
(SEQ ID NO: 1106)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M268-F10
(SEQ ID NO: 1107)
```
EVQLLESGGG LVQPGGSLRL SCAASGFTFS TYDMWWVRQA PGKGLEWVSV IYPSGGPTYY        60
ADSVKGRFTI SRDNSKNTLY LQMNSLRAED TAVYYCAKDR AYGDYVGWWNG FDYWGQGTLV      120
TVSS                                                                  124
```

LC for Fab M275-A02
(SEQ ID NO: 1108)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M275-A02
(SEQ ID NO: 1109)
```
EVQLLESGGG LVQPGGSLRL SCAASGFTFS TYDMWWVRQA PGKGLEWVSY ISSSGGGTFY        60
ADSVKGRFTI SRDNSKNTLY LQMNSLRAED TAVYYCAKDR AYGDYVGWNG FDYWGQGTLV       120
TVSS                                                                  124
```

LC for Fab M272-C08
(SEQ ID NO: 1110)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M272-C08
(SEQ ID NO: 1111)
```
EVQLLESGGG LVQPGGSLRL SCAASGFTFS TYEMWWVRQA PGKGLEWVSY ISSSGGGTGY        60
ADSVKGRFTI SRDNSKNTLY LQMNSLRAED TAVYYCAKDR AYGDYVGWNG FDYWGQGTLV       120
TVSS                                                                  124
```

LC for Fab M277-F06
(SEQ ID NO: 1112)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M277-F06
(SEQ ID NO: 1113)
```
EVQLLESGGG LVQPGGSLRL SCAASGFTFS TYPMFWVRQA PGKGLEWVSY ISPSGGYTDY        60
ADSVKGRFTI SRDNSKNTLY LQMNSLRAED TAVYYCAKDR AYGDYVGWNG FDYWGQGTLV       120
TVSS                                                                  124
```

LC for Fab M272-B07
(SEQ ID NO: 1114)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M272-B07
(SEQ ID NO: 1115)
```
EVQLLESGGG LVQPGGSLRL SCAASGFTFS TYPMIWVRQA PGKGLEWVSY IVPSGGYTGY        60
ADSVKGRFTI SRDNSKNTLY LQMNSLRAED TAVYYCAKDR AYGDYVGWNG FDYWGQGTLV       120
TVSS                                                                  124
```

-continued

LC for Fab M276-E12

(SEQ ID NO: 1116)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M276-E12

(SEQ ID NO: 1117)
```
EVQLLESGGG LVQPGGSLRL SCAASGFTFS TYPMMWVRQA PGKGLEWVSY IYPSGGATFY    60
ADSVKGRFTI SRDNSKNTLY LQMNSLRAED TAVYYCAKDR AYGDYVGWNG FDYWGQGTLV   120
TVSS                                                               124
```

LC for Fab M299-D12

(SEQ ID NO: 1118)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M299-D12

(SEQ ID NO: 1119)
```
EVQLLESGGG LVQPGGSLRL SCAASGFTFS TYPMWWVRQA PGKGLEWVSS ISPSGGATYY    60
ADSVKGRFTI SRDNSKNTLY LQMNSLRAED TAVYYCAKDR AYGDYVGWNG FDYWGQGTLV   120
TVSS                                                               124
```

LC for Fab M273-F01

(SEQ ID NO: 1120)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M273-F01

(SEQ ID NO: 1121)
```
EVQLLESGGG LVQPGGSLRL SCAASGFTFS TYPMWWVRQA PGKGLEWVSS IVPSGGATYY    60
ADSVKGRFTI SRDNSKNTLY LQMNSLRAED TAVYYCAKDR AYGDYVGWNG FDYWGQGTLV   120
TVSS                                                               124
```

LC for Fab M271-C07

(SEQ ID NO: 1122)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M271-C07

(SEQ ID NO: 1123)
```
EVQLLESGGG LVQPGGSLRL SCAASGFTFS TYPMWWVRQA PGKGLEWVSV IYSSGGYTGY    60
ADSVKGRFTI SRDNSKNTLY LQMNSLRAED TAVYYCAKDR AYGDYVGWNG FDYWGQGTLV   120
TVSS                                                               124
```

LC for Fab M269-H10

(SEQ ID NO: 1124)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M269-H10

(SEQ ID NO: 1125)
```
EVQLLESGGG LVQPGGSLRL SCAASGFTFS TYPMWWVRQA PGKGLEWVSY ISPSGGATFY    60
ADSVKGRFTI SRDNSKNTLY LQMNSLRAED TAVYYCAKDR AYGDYVGWNG FDYWGQGTLV   120
TVSS                                                               124
```

LC for Fab M268-B07

(SEQ ID NO: 1126)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M268-B07

(SEQ ID NO: 1127)
```
EVQLLESGGG LVQPGGSLRL SCAASGFTFS TYPMWWVRQA PGKGLEWVSY ISPSGGGTFY    60
ADSVKGRFTI SRDNSKNTLY LQMNSLRAED TAVYYCAKDR AYGDYVGWNG FDYWGQGTLV   120
TVSS                                                               124
```

LC for Fab M277-G07

(SEQ ID NO: 1128)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M277-G07

(SEQ ID NO: 1129)
```
EVQLLESGGG LVQPGGSLRL SCAASGFTFS TYPMWWVRQA PGKGLEWVSY IVPSGGYTDY    60
ADSVKGRFTI SRDNSKNTLY LQMNSLRAED TAVYYCAKDR AYGDYVGWNG FDYWGQGTLV   120
TVSS                                                               124
```

```
LC for Fab M273-F06
                                                    (SEQ ID NO: 1130)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M273-F06
                                                    (SEQ ID NO: 1131)
EVQLLESGGG LVQPGGSLRL SCAASGFTFS TYPMWWVRQA PGKGLEWVSY IYPSGGGTFY      60
ADSVKGRFTI SRDNSKNTLY LQMNSLRAED TAVYYCAKDR AYGDYVGWNG FDYWGQGTLV     120
TVSS                                                                 124

LC for Fab M274-E07
                                                    (SEQ ID NO: 1132)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M274-E07
                                                    (SEQ ID NO: 1133)
EVQLLESGGG LVQPGGSLRL SCAASGFTFS TYQMWWVRQA PGKGLEWVSS IYSSGGTFYA      60
DSVKGRFTIS RDNSKNTLYL QMNSLRAEDT AVYYCAKDRA YGDYVGWNGF DYWGQGTLVT     120
VSS                                                                  123

LC for Fab M276-F04
                                                    (SEQ ID NO: 1134)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M276-F04
                                                    (SEQ ID NO: 1135)
EVQLLESGGG LVQPGGSLRL SCAASGFTFS TYSMIWVRQA PGKGLEWVSY ISPSGGFTDY      60
ADSVKGRFTI SRDNSKNTLY LQMNSLRAED TAVYYCAKDR AYGDYVGWNG FDYWGQGTLV     120
TVSS                                                                 124

LC for Fab M270-A06
                                                    (SEQ ID NO: 1136)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M270-A06
                                                    (SEQ ID NO: 1137)
EVQLLESGGG LVQPGGSLRL SCAASGFTFS VYDMIWVRQA PGKGLEWVSY IGPSGGMTLY      60
ADSVKGRFTI SRDNSKNTLY LQMNSLRAED TAVYYCAKDR AYGDYVGWNG FDYWGQGTLV     120
TVSS                                                                 124

LC for Fab M274-G08
                                                    (SEQ ID NO: 1138)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M274-G08
                                                    (SEQ ID NO: 1139)
EVQLLESGGG LVQPGGSLRL SCAASGFTFS VYDMWWVRQA PGKGLEWVSV IYPSGGATYY      60
ADSVKGRFTI SRDNSKNTLY LQMNSLRAED TAVYYCAKDR AYGDYVGWNG FDYWGQGTLV     120
TVSS                                                                 124

LC for Fab M274-D12
                                                    (SEQ ID NO: 1140)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M274-D12
                                                    (SEQ ID NO: 1141)
EVQLLESGGG LVQPGGSLRL SCAASGFTFS VYDMWWVRQA PGKGLEWVSV IYPSGGYTDY      60
ADSVKGRFTI SRDNSKNTLY LQMNSLRAED TAVYYCAKDR AYGDYVGWNG FDYWGQGTLV     120
TVSS                                                                 124

LC for Fab M304-E10
                                                    (SEQ ID NO: 1142)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M304-E10
                                                    (SEQ ID NO: 1143)
EVQLLESGGG LVQPGGSLRL SCAASGFTFS VYDMWWVRQA PGKGLEWVSV IYSSGATFY       60
ADSVKGRFTI SRDNSKNTLY LQMNSLRAED TAVYYCAKDR AYGDYVGWNG FDYWGQGTLV     120
TVSS                                                                 124
```

```
LC for Fab M268-A02
                                                    (SEQ ID NO: 1144)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M268-A02
                                                    (SEQ ID NO: 1145)
EVQLLESGGG LVQPGGSLRL SCAASGFTFS VYDMWWVRQA PGKGLEWVSV IYSSGGPTFY    60
ADSVKGRFTI SRDNSKNTLY LQMNSLRAED TAVYYCAKDR AYGDYVGWNG FDYWGQGTLV   120
TVSS                                                               124

LC for Fab M272-B06
                                                    (SEQ ID NO: 1146)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M272-B06
                                                    (SEQ ID NO: 1147)
EVQLLESGGG LVQPGGSLRL SCAASGFTFS VYDMWWVRQA PGKGLEWVSY ISPSGGFTDY    60
ADSVKGRFTI SRDNSKNTLY LQMNSLRAED TAVYYCAKDR AYGDYVGWNG FDYWGQGTLV   120
TVSS                                                               124

LC for Fab M268-D04
                                                    (SEQ ID NO: 1148)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M268-D04
                                                    (SEQ ID NO: 1149)
EVQLLESGGG LVQPGGSLRL SCAASGFTFS VYEMWWVRQA PGKGLEWVSY ISPSGGGTFY    60
ADSVKGRFTI SRDNSKNTLY LQMNSLRAED TAVYYCAKDR AYGDYVGWNG FDYWGQGTLV   120
TVSS                                                               124

LC for Fab M298-G07
                                                    (SEQ ID NO: 1150)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M298-G07
                                                    (SEQ ID NO: 1151)
EVQLLESGGG LVQPGGSLRL SCAASGFTFS VYNMWWVRQA PGKGLEWVSS ISPSGGGTFY    60
ADSVKGRFTI SRDNSKNTLY LQMNSLRAED TAVYYCAKDR AYGDYVGWNG FDYWGQGTLV   120
TVSS                                                               124

LC for Fab M276-E09
                                                    (SEQ ID NO: 1152)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M276-E09
                                                    (SEQ ID NO: 1153)
EVQLLESGGG LVQPGGSLRL SCAASGFTFS VYPMWWVRQA PGKGLEWVSS ISPSGGATYY    60
ADSVKGRFTI SRDNSKNTLY LQMNSLRAED TAVYYCAKDR AYGDYVGWNG FDYWGQGTLV   120
TVSS                                                               124

LC for Fab M269-B04
                                                    (SEQ ID NO: 1154)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M269-B04
                                                    (SEQ ID NO: 1155)
EVQLLESGGG LVQPGGSLRL SCAASGFTFS VYPMWWVRQA PGKGLEWVSS ISPSGGYTGY    60
ADSVKGRFTI SRDNSKNTLY LQMNSLRAED TAVYYCAKDR AYGDYVGWNG FDYWGQGTLV   120
TVSS                                                               124

LC for Fab M299-D07
                                                    (SEQ ID NO: 1156)
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108

HC for Fab M299-D07
                                                    (SEQ ID NO: 1157)
EVQLLESGGG LVQPGGSLRL SCAASGFTFS VYPMWWVRQA PGKGLEWVSS ISSGGATYYA    60
DSVKGRFTIS RDNSKNTLYL QMNSLRAEDT AVYYCAKDRA YGDYVGWNGF DYWGQGTLVT   120
VSS                                                                123
```

```
LC for Fab M304-G02
                                                      (SEQ ID NO: 1158)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M304-G02
                                                      (SEQ ID NO: 1159)
EVQLLESGGG LVQPGGSLRL SCAASGFTFS VYPMWWVRQA PGKGLEWVSW ISPSGGGTFY       60
ADSVKGRFTI SRDNSKNTLY LQMNSLRAED TAVYYCAKDR AYGDYVGWNG FDYWGQGTLV      120
TVSS                                                                   124

LC for Fab M268-D05
                                                      (SEQ ID NO: 1160)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M268-D05
                                                      (SEQ ID NO: 1161)
EVQLLESGGG LVQPGGSLRL SCAASGFTFS VYPMWWVRQA PGKGLEWVSW ISSSGGGTAY       60
ADSVKGRFTI SRDNSKNTLY LQMNSLRAED TAVYYCAKDR AYGDYVGWNG FDYWGQGTLV      120
TVSS                                                                   124

LC for Fab M275-G10
                                                      (SEQ ID NO: 1162)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M275-G10
                                                      (SEQ ID NO: 1163)
EVQLLESGGG LVQPGGSLRL SCAASGFTFS VYPMWWVRQA PGKGLEWVSY IVPSGGATYY       60
ADSVKGRFTI SRDNSKNTLY LQMNSLRAED TAVYYCAKDR AYGDYVGWNG FDYWGQGTLV      120
TVSS                                                                   124

LC for Fab M276-G02
                                                      (SEQ ID NO: 1164)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M276-G02
                                                      (SEQ ID NO: 1165)
EVQLLESGGG LVQPGGSLRL SCAASGFTFS VYPMWWVRQA PGKGLEWVSY IYPSGGATYY       60
ADSVKGRFTI SRDNSKNTLY LQMNSLRAED TAVYYCAKDR AYGDYVGWNG FDYWGQGTLV      120
TVSS                                                                   124

LC for Fab M274-D10
                                                      (SEQ ID NO: 1166)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M274-D10
                                                      (SEQ ID NO: 1167)
EVQLLESGGG LVQPGGSLRL SCAASGFTFS VYQMWWVRQA PGKGLEWVSV IYPSGGTTFY       60
ADSVKGRFTI SRDNSKNTLY LQMNSLRAED TAVYYCAKDR AYGDYVGWNG FDYWGQGTLV      120
TVSS                                                                   124

LC for Fab M274-E12
                                                      (SEQ ID NO: 1168)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M274-E12
                                                      (SEQ ID NO: 1169)
EVQLLESGGG LVQPGGSLRL SCAASGFTFS VYWMIWVRQA PGKGLEWVSY ISPSGGGTFY       60
ADSVKGRFTI SRDNSKNTLY LQMNSLRAED TAVYYCAKDR AYGDYVGWNG FDYWGQGTLV      120
TVSS                                                                   124

LC for Fab M301-A06
                                                      (SEQ ID NO: 1170)
QDIQMTQSPA TLSLSPGERA TLSCRASQSI SSFLAWYQQK PGQAPRLLIY DASYRATGIP       60
ARFSGSGSGT DFTLTISSLE PEDYAVYYCQ QRGNWPITFG QGTRLEIK                  108

HC for Fab M301-A06
                                                      (SEQ ID NO: 1171)
EVQLLESGGG LVQPGGSLRL SCAASGFTFS WYAMWWVRQA PGKGLEWVSS ISPSGGGTYY       60
ADSVKGRFTI SRDNSKNTLY LQMNSLRAED TAVYYCAKDR AYGDYVGWNG FDYWGQGTLV      120
TVSS                                                                   124
```

-continued

LC for Fab M268-F01

(SEQ ID NO: 1172)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M268-F01

(SEQ ID NO: 1173)
```
EVQLLESGGG LVQPGGSLRL SCAASGFTFS WYDMFWVRQA PGKGLEWVSS ISPSGGATFY      60
ADSVKGRFTI SRDNSKNTLY LQMNSLRAED TAVYYCAKDR AYGDYVGWNG FDYWGQGTLV    120
TVSS                                                                  124
```

LC for Fab M268-D08

(SEQ ID NO: 1174)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M268-D08

(SEQ ID NO: 1175)
```
EVQLLESGGG LVQPGGSLRL SCAASGFTFS WYDMWWVRQA PGKGLEWVSV IYPSGGATYY      60
ADSVKGRFTI SRDNSKNTLY LQMNSLRAED TAVYYCAKDR AYGDYVGWNG FDYWGQGTLV    120
TVSS                                                                  124
```

LC for Fab M268-B04

(SEQ ID NO: 1176)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M268-B04

(SEQ ID NO: 1177)
```
EVQLLESGGG LVQPGGSLRL SCAASGFTFS WYDMWWVRQA PGKGLEWVSV IYPSGGFTDY      60
ADSVKGRFTI SRDNSKNTLY LQMNSLRAED TAVYYCAKDR AYGDYVGWNG FDYWGQGTLV    120
TVSS                                                                  124
```

LC for Fab M270-B04

(SEQ ID NO: 1178)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M270-B04

(SEQ ID NO: 1179)
```
EVQLLESGGG LVQPGGSLRL SCAASGFTFS WYDMWWVRQA PGKGLEWVSV IYPSGGYTGY      60
ADSVKGRFTI SRDNSKNTLY LQMNSLRAED TAVYYCAKDR AYGDYVGWNG FDYWGQGTLV    120
TVSS                                                                  124
```

LC for Fab M268-D07

(SEQ ID NO: 1180)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M268-D07

(SEQ ID NO: 1181)
```
EVQLLESGGG LVQPGGSLRL SCAASGFTFS WYDMWWVRQA PGKGLEWVSV IYSSGGATFY      60
ADSVKGRFTI SRDNSKNTLY LQMNSLRAED TAVYYCAKDR AYGDYVGWNG FDYWGQGTLV    120
TVSS                                                                  124
```

LC for Fab M276-F11

(SEQ ID NO: 1182)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M276-F11

(SEQ ID NO: 1183)
```
EVQLLESGGG LVQPGGSLRL SCAASGFTFS WYDMWWVRQA PGKGLEWVSV IYSSGGPTFY      60
ADSVKGRFTI SRDNSKNTLY LQMNSLRAED TAVYYCAKDR AYGDYVGWNG FDYWGQGTLV    120
TVSS                                                                  124
```

LC for Fab M274-D03

(SEQ ID NO: 1184)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M274-D03

(SEQ ID NO: 1185)
```
EVQLLESGGG LVQPGGSLRL SCAASGFTFS WYEMWWVRQA PGKGLEWVSW ISPGGGTQY       60
ADSVKGRFTI SRDNSKNTLY LQMNSLRAED TAVYYCAKDR AYGDYVGWNG FDYWGQGTLV    120
TVSS                                                                  124
```

```
LC for Fab M274-H06
                                                       (SEQ ID NO: 1186)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M274-H06
                                                       (SEQ ID NO: 1187)
EVQLLESGGG LVQPGGSLRL SCAASGFTFS WYEMWWVRQA PGKGLEWVSY ISPSGGGTYY      60
ADSVKGRFTI SRDNSKNTLY LQMNSLRAED TAVYYCAKDR AYGDYVGWNG FDYWGQGTLV    120
TVSS                                                                 124

LC for Fab M270-D07
                                                       (SEQ ID NO: 1188)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M270-D07
                                                       (SEQ ID NO: 1189)
EVQLLESGGG LVQPGGSLRL SCAASGFTFS WYNMWWVRQA PGKGLEWVSV IYPSGGGTFY      60
ADSVKGRFTI SRDNSKNTLY LQMNSLRAED TAVYYCAKDR AYGDYVGWNG FDYWGQGTLV    120
TVSS                                                                 124

LC for Fab M274-F11
                                                       (SEQ ID NO: 1190)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M274-F11
                                                       (SEQ ID NO: 1191)
EVQLLESGGG LVQPGGSLRL SCAASGFTFS WYNMWWVRQA PGKGLEWVSY IVSSGGFTDY      60
ADSVKGRFTI SRDNSKNTLY LQMNSLRAED TAVYYCAKDR AYGDYVGWNG FDYWGQGTLV    120
TVSS                                                                 124

LC for Fab M275-B07
                                                       (SEQ ID NO: 1192)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M275-B07
                                                       (SEQ ID NO: 1193)
EVQLLESGGG LVQPGGSLRL SCAASGFTFS WYPMIWVRQA PGKGLEWVSY ISSSGGYTSY      60
ADSVKGRFTI SRDNSKNTLY LQMNSLRAED TAVYYCAKDR AYGDYVGWNG FDYWGQGTLV    120
TVSS                                                                 124

LC for Fab M274-C07
                                                       (SEQ ID NO: 1194)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M274-C07
                                                       (SEQ ID NO: 1195)
EVQLLESGGG LVQPGGSLRL SCAASGFTFS WYPMTWVRQA PGKGLEWVSY ISPSGGYTGY      60
ADSVKGRFTI SRDNSKNTLY LQMNSLRAED TAVYYCAKDR AYGDYVGWNG FDYWGQGTLV    120
TVSS                                                                 124

LC for Fab M275-H02
                                                       (SEQ ID NO: 1196)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M275-H02
                                                       (SEQ ID NO: 1197)
EVQLLESGGG LVQPGGSLRL SCAASGFTFS WYPMVWVRQA PGKGLEWVSY IYPSGGGTFY      60
ADSVKGRFTI SRDNSKNTLY LQMNSLRAED TAVYYCAKDR AYGDYVGWNG FDYWGQGTLV    120
TVSS                                                                 124

LC for Fab M276-B06
                                                       (SEQ ID NO: 1198)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108

HC for Fab M276-B06
                                                       (SEQ ID NO: 1199)
EVQLLESGGG LVQPGGSLRL SCAASGFTFS WYPMWWVRQA PGKGLEWVSS ISPSGGATYY      60
ADSVKGRFTI SRDNSKNTLY LQMNSLRAED TAVYYCAKDR AYGDYVGWNG FDYWGQGTLV    120
TVSS                                                                 124
```

-continued

LC for Fab M305-H03

(SEQ ID NO: 1200)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M305-H03

(SEQ ID NO: 1201)
```
EVQLLESGGG LVQPGGSLRL SCAASGFTFS WYPMWWVRQA PGKGLEWVSS IVPSGGATYY    60
ADSVKGRFTI SRDNSKNTLY LQMNSLRAED TAVYYCAKDR AYGDYVGWNG FDYWGQGTLV   120
TVSS                                                                124
```

LC for Fab M272-G03

(SEQ ID NO: 1202)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M272-G03

(SEQ ID NO: 1203)
```
EVQLLESGGG LVQPGGSLRL SCAASGFTFS WYPMWWVRQA PGKGLEWVSV IYPSGGYTSY    60
ADSVKGRFTI SRDNSKNTLY LQMNSLRAED TAVYYCAKDR AYGDYVGWNG FDYWGQGTLV   120
TVSS                                                                124
```

LC for Fab M268-G05

(SEQ ID NO: 1204)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M268-G05

(SEQ ID NO: 1205)
```
EVQLLESGGG LVQPGGSLRL SCAASGFTFS WYPMWWVRQA PGKGLEWVSV IYSSGGATFY    60
ADSVKGRFTI SRDNSKNTLY LQMNSLRAED TAVYYCAKDR AYGDYVGWNG FDYWGQGTLV   120
TVSS                                                                124
```

LC for Fab M303-H08

(SEQ ID NO: 1206)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M303-H08

(SEQ ID NO: 1207)
```
EVQLLESGGG LVQPGGSLRL SCAASGFTFS WYPMWWVRQA PGKGLEWVSV IYSSGGYTGY    60
ADSVKGRFTI SRDNSKNTLY LQMNSLRAED TAVYYCAKDR AYGDYVGWNG FDYWGQGTLV   120
TVSS                                                                124
```

LC for Fab M271-C10

(SEQ ID NO: 1208)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M271-C10

(SEQ ID NO: 1209)
```
EVQLLESGGG LVQPGGSLRL SCAASGFTFS WYPMWWVRQA PGKGLEWVSY IVPSGGATFY    60
ADSVKGRFTI SRDNSKNTLY LQMNSLRAED TAVYYCAKDR AYGDYVGWNG FDYWGQGTLV   120
TVSS                                                                124
```

LC for Fab M274-B03

(SEQ ID NO: 1210)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M274-B03

(SEQ ID NO: 1211)
```
EVQLLESGGG LVQPGGSLRL SCAASGFTFS WYPMWWVRQA PGKGLEWVSY IVPSGGRTYY    60
ADSVKGRFTI SRDNSKNTLY LQMNSLRAED TAVYYCAKDR AYGDYVGWNG FDYWGQGTLV   120
TVSS                                                                124
```

LC for Fab M277-B08

(SEQ ID NO: 1212)
```
QDIQMTQSPA TLSLSPGERA TLSCRASQSI SSFLAWYQQK PGQAPRLLIY DASYRATGIP    60
ARFSGSGSGT DFTLTISSLE PEDYAVYYCQ QRGNWPITFG QGTRLEIK               108
```

HC for Fab M277-B08

(SEQ ID NO: 1213)
```
EVQLLESGGG LVQPGGSLRL SCAASGFTFS WYSMWWVRQA PGKGLEWVSV IYPSGGGTFY    60
ADSVKGRFTI SRDNSKNTLY LQMNSLRAED TAVYYCAKDR AYGDYVGWNG FDYWGQGTLV   120
TVSS                                                                124
```

LC for Fab M273-D09

(SEQ ID NO: 1214)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M273-D09

(SEQ ID NO: 1215)

```
EVQLLESGGG LVQPGGSLRL SCAASGFTFS WYTMWVRQA PGKGLEWVSS ISPSGGGTYY       60
ADSVKGRFTI SRDNSKNTLY LQMNSLRAED TAVYYCAKDR AYGDYVGWNG FDYWGQGTLV     120
TVSS                                                                 124
```

LC for Fab M273-C04

(SEQ ID NO: 1216)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M273-C04

(SEQ ID NO: 1217)

```
EVQLLESGGG LVQPGGSLRL SCAASGFTFS WYYMIWVRQA PGKGLEWVSY ISPSGGGTYY      60
ADSVKGRFTI SRDNSKNTLY LQMNSLRAED TAVYYCAKDR AYGDYVGWNG FDYWGQGTLV     120
TVSS                                                                 124
```

LC for Fab M275-H04

(SEQ ID NO: 1218)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M275-H04

(SEQ ID NO: 1219)

```
EVQLLESGGG LVQPGGSLRL SCAASGFTFS YYDMIWVRQA PGKGLEWVSW ISPSGGLTMY      60
ADSVKGRFTI SRDNSKNTLY LQMNSLRAED TAVYYCAKDR AYGDYVGWNG FDYWGQGTLV     120
TVSS                                                                 124
```

LC for Fab M271-G11

(SEQ ID NO: 1220)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M271-G11

(SEQ ID NO: 1221)

```
EVQLLESGGG LVQPGGSLRL SCAASGFTFS YYDMIWVRQA PGKGLEWVSY IVPSGGYTSY      60
ADSVKGRFTI SRDNSKNTLY LQMNSLRAED TAVYYCAKDR AYGDYVGWNG FDYWGQGTLV     120
TVSS                                                                 124
```

LC for Fab M271-F08

(SEQ ID NO: 1222)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M271-F08

(SEQ ID NO: 1223)

```
EVQLLESGGG LVQPGGSLRL SCAASGFTFS YYDMVWVRQA PGKGLEWVSY ISPSGGFTLY      60
ADSVKGRFTI SRDNSKNTLY LQMNSLRAED TAVYYCAKDR AYGDYVGWNG FDYWGQGTLV     120
TVSS                                                                 124
```

LC for Fab M268-D01

(SEQ ID NO: 1224)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M268-D01

(SEQ ID NO: 1225)

```
EVQLLESGGG LVQPGGSLRL SCAASGFTFS YYDMWVRQA PGKGLEWVSS ISPSGGFTGY       60
ADSVKGRFTI SRDNSKNTLY LQMNSLRAED TAVYYCAKDR AYGDYVGWNG FDYWGQGTLV     120
TVSS                                                                 124
```

LC for Fab M304-E11

(SEQ ID NO: 1226)

```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108
```

HC for Fab M304-E11

(SEQ ID NO: 1227)

```
EVQLLESGGG LVQPGGSLRL SCAASGFTFS YYDMWVRQA PGKGLEWVSV ISSSGGGTFY       60
ADSVKGRFTI SRDNSKNTLY LQMNSLRAED TAVYYCAKDR AYGDYVGWNG FDYWGQGTLV     120
TVSS                                                                 124
```

-continued

LC for Fab M301-B04
(SEQ ID NO: 1228)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M301-B04
(SEQ ID NO: 1229)
```
EVQLLESGGG LVQPGGSLRL SCAASGFTFS YYDMWWVRQA PGKGLEWVSV IYPSGGTTFY        60
ADSVKGRFTI SRDNSKNTLY LQMNSLRAED TAVYYCAKDR AYGDYVGWNG FDYWGQGTLV       120
TVSS                                                                   124
```

LC for Fab M301-A09
(SEQ ID NO: 1230)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M301-A09
(SEQ ID NO: 1231)
```
EVQLLESGGG LVQPGGSLRL SCAASGFTFS YYDMWWVRQA PGKGLEWVSV IYPSGGYTAY        60
ADSVKGRFTI SRDNSKNTLY LQMNSLRAED TAVYYCAKDR AYGDYVGWNG FDYWGQGTLV       120
TVSS                                                                   124
```

LC for Fab M268-H12
(SEQ ID NO: 1232)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M268-H12
(SEQ ID NO: 1233)
```
EVQLLESGGG LVQPGGSLRL SCAASGFTFS YYDMWWVRQA PGKGLEWVSY ISSSGGGTYY        60
ADSVKGRFTI SRDNSKNTLY LQMNSLRAED TAVYYCAKDR AYGDYVGWNG FDYWGQGTLV       120
TVSS                                                                   124
```

LC for Fab M273-H09
(SEQ ID NO: 1234)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M273-H09
(SEQ ID NO: 1235)
```
EVQLLESGGG LVQPGGSLRL SCAASGFTFS YYEMWWVRQA PGKGLEWVSY ISSSGGFTSY        60
ADSVKGRFTI SRDNSKNTLY LQMNSLRAED TAVYYCAKDR AYGDYVGWNG FDYWGQGTLV       120
TVSS                                                                   124
```

LC for Fab M303-A02
(SEQ ID NO: 1236)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M303-A02
(SEQ ID NO: 1237)
```
EVQLLESGGG LVQPGGSLRL SCAASGFTFS YYGMWWVRQA PGKGLEWVSV ISPSGGGTFY        60
ADSVKGRFTI SRDNSKNTLY LQMNSLRAED TAVYYCAKDR AYGDYVGWNG FDYWGQGTLV       120
TVSS                                                                   124
```

LC for Fab M273-G09
(SEQ ID NO: 1238)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M273-G09
(SEQ ID NO: 1239)
```
EVQLLESGGG LVQPGGSLRL SCAASGFTFS YYMMIWVRQA PGKGLEWVSG IVSSGGFTMY        60
ADSVKGRFTI SRDNSKNTLY LQMNSLRAED TAVYYCAKDR AYGDYVGWNG FDYWGQGTLV       120
TVSS                                                                   124
```

LC for Fab M274-A08
(SEQ ID NO: 1240)
```
QDIQMTQSPA TLSLSPGERA TLSCRASQSI SSFLAWYQQK PGQAPRLLIY DASYRATGIP        60
ARFSGSGSGT DFTLTISSLE PEDYAVYYCQ QRGNWPITFG QGTRLEIK                   108
```

HC for Fab M274-A08
(SEQ ID NO: 1241)
```
EVQLLESGGG LVQPGGSLRL SCAASGFTFS YYMMWWVRQA PGKGLEWVSS ISSSGGGTFY        60
ADSVKGRFTI SRDNSKNTLY LQMNSLRAED TAVYYCAKDR AYGDYVGWNG FDYWGQGTLV       120
TVSS                                                                   124
```

```
LC for Fab M268-H06
                                                       (SEQ ID NO: 1242)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M268-H06
                                                       (SEQ ID NO: 1243)
EVQLLESGGG LVQPGGSLRL SCAASGFTFS YYMMWVRQA PGKGLEWVSS IYSSGGATFY       60
ADSVKGRFTI SRDNSKNTLY LQMNSLRAED TAVYYCAKDR AYGDYVGWNG FDYWGQGTLV     120
TVSS                                                                  124

LC for Fab M273-F05
                                                       (SEQ ID NO: 1244)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M273-F05
                                                       (SEQ ID NO: 1245)
EVQLLESGGG LVQPGGSLRL SCAASGFTFS YYNMWVRQA PGKGLEWVSS ISPSGGGTYY       60
ADSVKGRFTI SRDNSKNTLY LQMNSLRAED TAVYYCAKDR AYGDYVGWNG FDYWGQGTLV     120
TVSS                                                                  124

LC for Fab M268-E02
                                                       (SEQ ID NO: 1246)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M268-E02
                                                       (SEQ ID NO: 1247)
EVQLLESGGG LVQPGGSLRL SCAASGFTFS YYPMFWVRQA PGKGLEWVSY ISPSGGWTDY      60
ADSVKGRFTI SRDNSKNTLY LQMNSLRAED TAVYYCAKDR AYGDYVGWNG FDYWGQGTLV     120
TVSS                                                                  124

LC for Fab M271-E09
                                                       (SEQ ID NO: 1248)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M271-E09
                                                       (SEQ ID NO: 1249)
EVQLLESGGG LVQPGGSLRL SCAASGFTFS YYPMIWVRQA PGKGLEWVSW ISPSGGGTQY      60
ADSVKGRFTI SRDNSKNTLY LQMNSLRAED TAVYYCAKDR AYGDYVGWNG FDYWGQGTLV     120
TVSS                                                                  124

LC for Fab M275-G05
                                                       (SEQ ID NO: 1250)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M275-G05
                                                       (SEQ ID NO: 1251)
EVQLLESGGG LVQPGGSLRL SCAASGFTFS YYPMVWVRQA PGKGLEWVSY IWPSGGTYYA      60
DSVKGRFTIS RDNSKNTLYL QMNSLRAEDT AVYYCAKDRA YGDYVGWNGF DYWGQGTLVT     120
VSS                                                                   123

LC for Fab M277-G02
                                                       (SEQ ID NO: 1252)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M277-G02
                                                       (SEQ ID NO: 1253)
EVQLLESGGG LVQPGGSLRL SCAASGFTFS YYPMWVRQA PGKGLEWVSS IVPSGGATFY       60
ADSVKGRFTI SRDNSKNTLY LQMNSLRAED TAVYYCAKDR AYGDYVGWNG FDYWGQGTLV     120
TVSS                                                                  124

LC for Fab M270-H05
                                                       (SEQ ID NO: 1254)
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                  108

HC for Fab M270-H05
                                                       (SEQ ID NO: 1255)
EVQLLESGGG LVQPGGSLRL SCAASGFTFS YYPMWVRQA PGKGLEWVSV IYPSGGATFY       60
ADSVKGRFTI SRDNSKNTLY LQMNSLRAED TAVYYCAKDR AYGDYVGWNG FDYWGQGTLV     120
TVSS                                                                  124
```

-continued

LC for Fab M273-A06
(SEQ ID NO: 1256)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M273-A06
(SEQ ID NO: 1257)
```
EVQLLESGGG LVQPGGSLRL SCAASGFTFS YYPMWWVRQA PGKGLEWVSY ISSSGGGTHY      60
ADSVKGRFTI SRDNSKNTLY LQMNSLRAED TAVYYCAKDR AYGDYVGWNG FDYWGQGTLV    120
TVSS                                                                 124
```

LC for Fab M276-F08
(SEQ ID NO: 1258)
```
QDIQMTQSPA TLSLSPGERA TLSCRASQSI SSFLAWYQQK PGQAPRLLIY DASYRATGIP      60
ARFSGSGSGT DFTLTISSLE PEDYAVYYCQ QRGNWPITFG QGTRLEIK                 108
```

HC for Fab M276-F08
(SEQ ID NO: 1259)
```
EVQLLESGGG LVQPGGSLRL SCAASGFTFS YYPMWWVRQA PGKGLEWVSY IVPSGGATFY      60
ADSVKGRFTI SRDNSKNTLY LQMNSLRALD TAVYYCAKDR AYGDYVGWNG FDYWGQGTLV    120
TVSS                                                                 124
```

TABLE 6 difference in CDR1 and CDR2 HCs for MMP9/2 derived from
M237-D02 at positions 25-66
(SEQ ID NOS 5054-5521, respectively, in order of appearance)
Non-standard position 58a is allowed so that isolates having
insertions appear more newly aligned.

```
                     FR1------------CDR1-FR2-----------CDR2--------------FR3---
                     2     3     3     4     4     5     5     6     6
                     5     0     5     0     5     0  a  5     a  0     5
HCM237-D02_parent    SGFTFSQYPMWWVRQAPGKGLEWVSYIVPSGGRTY#YADSVKGR
3-23_wild_type___    ------S-A-S----------------A-SG---S--#--------
HCM256-D03_SIN11__   ------V---I----------------S----F-G#--------
HCM256-E10_SIN13__   ------D--------------------V-Y----A-F#--------
HCM256-E03_SIN15__   ------T---I----------------S----Y-G#--------
HCM256-D11_SIN17__   ------H-D------------------V-YS---P-F#--------
HCM256-A04_SIN19__   ------H--------------------S-S----A-#--------
HCM256-G09_SIN21__   ------K--------------------S-Y----A-F#--------
HCM256-A07_SIN23__   ------H-D-L----------------SS---Y-G#--------
HCM256-C09_SIN25__   ------K--------------------SS---G-F#--------
HCM256-C07_SIN27__   ------L-D------------------SS---A-F#--------
HCM256-B03_SIN29__   ------R--------------------S----F-S#--------
HCM269-C02_SIN349_   ------T--------------------SS---G--#--------
HCM277-C02_SIN351_   ------A-D-I----------------F-D#--------
HCM272-H08_SIN353_   ------A-D------------------V-Y----T-F#--------
HCM271-D10_SIN355_   ------A-D------------------V-YS---M-L#--------
HCM271-E12_SIN357_   ------A-D------------------SS---F-D#--------
HCM269-C06_SIN359_   ------A-E------------------S-Y----Y-D#--------
HCM271-G01_SIN361_   ------A-E------------------V-Y----G-F#--------
HCM270-F03_SIN363_   ------A-M------------------A-S----Y-G#--------
HCM270-G04_SIN365_   ------A-N-I----------------F-G#--------
HCM268-E01_SIN367_   ------A---I----------------A-F#--------
HCM269-F07_SIN369_   ------A---M----------------Y----G-F#--------
HCM299-C10_SIN371_   ------A--------------------M--#--------
HCM274-D05_SIN373_   ------A--------------------Y----A-F#--------
HCM300-F10_SIN375_   ------D-A------------------S-Y----A-F#--------
HCM269-D11_SIN377_   ------D-A------------------W-S----G-L#--------
HCM271-D08_SIN379_   ------D-D-F----------------G--S---Y-G#--------
HCM268-A12_SIN381_   ------D-D------------------V-S----Y-G#--------
HCM277-A06_SIN383_   ------D-D------------------V-Y----F-G#--------
HCM272-E06_SIN385_   ------D-D------------------V-YSG-#S--#--------
HCM271-A10_SIN387_   ------D-D------------------V-YS---F-S#--------
HCM275-F06_SIN389_   ------D-D------------------V-YS---M--#--------
HCM277-E12_SIN391_   ------D-M------------------S-S----F-D#--------
HCM269-B06_SIN393_   ------D-N------------------V-Y----W-M#--------
HCM271-B04_SIN395_   ------D---F----------------W-D#--------
HCM306-C02_SIN397_   ------D---F----------------W-S#--------
HCM277-G06_SIN399_   ------D---I----------------S----Y-D#--------
HCM277-G04_SIN401_   ------D---I----------------W-D#--------
HCM298-C05_SIN403_   ------D---I----------------Y----G--#--------
HCM268-C12_SIN405_   ------D--------------------SS---W-S#--------
HCM269-F03_SIN407_   ------D--------------------Y----A--#--------
HCM271-A08_SIN409_   ------D-Q------------------V-Y----A-F#--------
HCM272-D08_SIN411_   ------E-D------------------V-Y----P--#--------
HCM275-G03_SIN413_   ------E-D------------------V-YS---Y-G#--------
HCM271-A11_SIN415_   ------E-E------------------V-Y----Y-N#--------
```

TABLE 6-continued difference in CDR1 and CDR2 HCs for MMP9/2 derived from
M237-D02 at positions 25-66
(SEQ ID NOS 5054-5521, respectively, in order of appearance)
Non-standard position 58a is allowed so that isolates having
insertions appear more newly aligned.

```
HCM269-G06_SIN417_   ------E-N----------------V-Y----P-W#--------
HCM272-E03_SIN419_   ------E---F--------------S----W-S#--------
HCM276-G10_SIN421_   ------E---I--------------S----Y-G#--------
HCM269-H08_SIN423_   ------E------------------S-Y----A-F#--------
HCM300-A11_SIN425_   ------E-W----------------S-S----G-F#--------
HCM274-D02_SIN427_   ------F-D-F--------------V-SS---G-F#--------
HCM269-H01_SIN429_   ------F-D-L--------------SS----F-G#--------
HCM272-D07_SIN431_   ------F-D----------------S-YS---A-F#--------
HCM271-A12_SIN433_   ------F-D----------------V-YS---A-F#--------
HCM270-G05_SIN435_   ------F-D----------------V-YS---F-D#--------
HCM270-C10_SIN437_   ------F-D----------------SS---G-F#--------
HCM269-D09_SIN439_   ------F-D-Y--------------S------A-F#--------
HCM277-B07_SIN441_   ------F-E----------------S----G--#--------
HCM300-H04_SIN443_   ------F-H-I--------------YS---#-F#--------
HCM271-H08_SIN445_   ------F-M----------------S-S----A-F#--------
HCM306-H03_SIN447_   ------F-N----------------S-S----G-F#--------
HCM275-F06_SIN449_   ------F-N----------------V-Y----K--#--------
HCM299-C08_SIN451_   ------F-N----------------V-Y----P-F#--------
HCM274-D08_SIN453_   ------F---I--------------S----S-L#--------
HCM303-H07_SIN455_   ------F---I--------------SS---F-D#--------
HCM272-C10_SIN457_   ------F---I--------------SS---Y-S#--------
HCM269-C08_SIN459_   ------F---L--------------S#G-#Y-G#--------
HCM270-F07_SIN461_   ------F---M--------------SF---Y-G#--------
HCM273-C10_SIN463_   ------F------------------Y----A-F#--------
HCM275-H08_SIN465_   ------G-D----------------V-S----G-F#--------
HCM269-C11_SIN467_   ------G-D----------------V-YS---T-F#--------
HCM304-B05_SIN469_   ------G-N----------------V-Y----A-F#--------
HCM276-F12_SIN471_   ------G------------------SS---G-F#--------
HCM299-D06_SIN473_   ------H-A-I--------------------W-D#--------
HCM271-G12_SIN475_   ------H-A-I--------------------W-G#--------
HCM272-G11_SIN477_   ------H-D----------------S-S----A-F#--------
HCM269-H12_SIN479_   ------H-D----------------V--S--#K-F#--------
HCM268-A01_SIN481_   ------H-D----------------V-Y----F-D#--------
HCM277-B12_SIN483_   ------H-D----------------V-Y----H-L#--------
HCM273-G07_SIN485_   ------H-D----------------V-Y----P--#--------
HCM274-F01_SIN487_   ------H-D----------------V-Y----V--#--------
HCM275-E12_SIN489_   ------H-D----------------V-YS---F-G#--------
HCM298-E01_SIN491_   ------H-D----------------V-YS---P--#--------
HCM274-G10_SIN493_   ------H-D------------------S----F-S#--------
HCM268-G01_SIN495_   ------H-E----------------S-SS---G-F#--------
HCM269-H02_SIN497_   ------H-E----------------GS---S--#--------
HCM277-G05_SIN499_   ------H-M-I--------------G-S----Y-G#--------
HCM271-H01_SIN501_   ------H-M----------------S-Y----G--#--------
HCM303-F06_SIN503_   ------H-M----------------S-Y----#--#--------
HCM272-B03_SIN505_   ------H---F--------------SS---W-D#--------
HCM272-B04_SIN507_   ------H---I--------------S----G-F#--------
HCM272-B03_SIN509_   ------H---I--------------SS---G-F#--------
HCM274-G12_SIN511_   ------H---I--------------YS---G-F#--------
HCM274-F02_SIN513_   ------H---L--------------Y----G-F#--------
HCM276-H11_SIN515_   ------H---M--------------SS---Y-G#--------
HCM303-C04_SIN517_   ------H---M--------------YS---G--#--------
HCM276-G09_SIN519_   ------H---V--------------S----Y-G#--------
HCM298-D05_SIN521_   ------H------------------S-S----A-F#--------
HCM305-G05_SIN523_   ------H------------------V-YS---G-F#--------
HCM269-D03_SIN525_   ------H------------------W------F-L#--------
HCM275-A08_SIN527_   ------H------------------H----G-L#--------
HCM299-A12_SIN529_   ------H------------------SS---G-F#--------
HCM302-D10_SIN531_   ------H-----------------------A-F#--------
HCM272-H12_SIN533_   ------H------------------Y-----G--#--------
HCM304-G08_SIN535_   ------H-Q----------------S-SS---G--#--------
HCM298-A01_SIN557_   ------H-S-M----D-----------S----Y-G#--------
HCM272-E07_SIN539_   ------H-S----------------V-Y----A-F#--------
HCM268-F03_SIN541_   ------I-D----------------V-S----S--#--------
HCM268-B08_SIN543_   ------I-D----------------V-Y----A-W#--------
HCM271-A03_SIN545_   ------I-D----------------V-Y----P-F#--------
HCM270-G02_SIN547_   ------I-D----------------V-Y----V-F#--------
HCM277-H05_SIN549_   ------I-D----------------V-YS---F-G#--------
HCM273-F04_SIN551_   ------I---I--------------S----Y-S#--------
HCM268-G10_SIN553_   ------I------------------S----F-S#--------
HCM300-F01_SIN555_   ------I------------------S----G--#--------
HCM273-H03_SIN557_   ------I------------------SS---W-D#--------
HCM277-C11_SIN559_   ------I----------------------M--#--------
HCM273-G06_SIN561_   ------I------------------Y----G-F#--------
HCM27S-B10_SIN563_   ------K-A-I--------------W-P----Y-S#--------
```

TABLE 6-continued difference in CDR1 and CDR2 HCs for MMP9/2 derived from
M237-D02 at positions 25-66
(SEQ ID NOS 5054-5521, respectively, in order of appearance)
Non-standard position 58a is allowed so that isolates having
insertions appear more newly aligned.

```
HCM272-F08_SIN565_    ------K-A-I----------------S----F-G#--------
HCM270-G12_SIN567_    ------K-A-I---S------------SS---F-D#--------
HCM274-H05_SIN569_    ------K-A----------------S-S---G-F#--------
HCM271-F05_SIN571_    ------K-A----------------------F#--------
HCM275-H08_SIN573_    ------K-D-F--------------S------A--#--------
HCM271-H02_SIN575_    ------K-D-I--------------W-G----A-M#--------
HCM306-A12_SIN577_    ------K-D-I--------------GS---Y-G#--------
HCM271-B06_SIN579_    ------K-D----------------S-SS---G-F#--------
HCM271-D01_SIN581_    ------K-D----------------V-Y----P-F#--------
HCM269-H03_SIN583_    ------K-D----------------V-Y----Q--#--------
HCM274-H01_SIN585_    ------K-D----------------V-Y----S--#--------
HCM275-B12_SIN587_    ------K-D----------------V-YS---F-L#--------
HCM270-H06_SIN589_    ------K-D----------------V-YS---F-S#--------
HCM271-A04_SIN591_    ------K-D----------------V-YS---P-F#--------
HCM272-C09_SIN593_    ------K-D------------------G----F-D#--------
HCM274-G09_SIN595_    ------K-D------------------SS---F-D#--------
HCM299-F05_SIN597_    ------K-D----------------------FID#--------
HCM275-B05_SIN599_    ------K-E-F--------------S-SS---G-F#--------
HCM271-H05_SIN601_    ------K-E----------------V-Y----M--#--------
HCM277-D11_SIN603_    ------K-E----------------V-Y----Y-G#--------
HCM268-B02_SIN605_    ------K-E----------------V-YS---K--#--------
HCM275-E04_SIN607_    ------K-E------------------G----F-D#--------
HCM275-D12_SIN609_    ------K-E------------------G----I-M#--------
HCM270-A02_SIN611_    ------K-E----------------S----G-L#--------
HCM277-F09_SIN613_    ------K-M-F--------------S-YS-----F#--------
HCM269-G12_SIN615_    ------K-N----------------S-Y----A-F#--------
HCM273-G04_SIN617_    ------K-N----------------V-Y----A-F#--------
HCM269-G04_SIN619_    ------K---F---------------------Y-S#--------
HCM269-B01_SIN621_    ------K---I--------------S----Y-G#--------
HCM268-B06_SIN623_    ------K---I--------------S----Y-S#--------
HCM272-A11_SIN625_    ------K---I--------------SS---W-D#--------
HCM274-H02_SIN627_    ------K---I--------------Y----A--#--------
HCM275-C12_SIN629_    ------K---I--------------Y----Y-S#--------
HCM268-G12_SIN631_    ------K---I--------------YS---G--#--------
HCM271-C02_SIN633_    ------K---M--------------S----F-D#--------
HCM268-E09_SIN655_    ------K---M--------------Y----Y-D#--------
HCM274-F09_SIN657_    ------K---M--------------Y----Y-G#--------
HCM271-F02_SIN659_    ------K------------------S--S---A--#-T------
HCM276-B12_SIN641_    ------K------------------S-Y----Y-G#--------
HCM272-H09_SIN643_    ------K------------------V-S----A--#--------
HCM272-G02_SIN645_    ------K------------------V-Y----Y-A#--------
HCM274-E04_SIN647_    ------K------------------V-YS---G-F#--------
HCM303-B07_SIN649_    ------K--------------------S----G-L#--------
HCM275-D06_SIN651_    ------K--------------------S----G--#--------
HCM271-D04_SIN653_    ------K--------------------SS---G--#--------
HCM268-H03_SIN655_    ------K--------------------------A-F#--------
HCM272-A03_SIN657_    ------K--------------------------P-W#--------
HCM274-G07_SIN659_    ------K--------------------------W-A#--------
HCM270-E01_SIN661_    ------K-Q----------------S-Y----A-F#--------
HCM270-G09_SIN663_    ------K-Q----------------S-Y----G-F#--------
HCM272-B11_SIN665_    ------K-S-I--------------------Y-G#--------
HCM268-C03_SIN667_    ------K-S----------------S-Y----A-F#--------
HCM270-E10_SIN669_    ------K-S----------------V-Y----A-F#--------
HCM305-F06_SIN671_    ------K-S----------------V-Y----F-D#--------
HCM270-H04_SIN673_    ------K-T----------------V-Y----A-F#--------
HCM269-D05_SIN675_    ------K-W----------------V------M--#--------
HCM270-F02_SIN677_    ------K-Y----------------S-YS---G-F#--------
HCM275-D07_SIN679_    ------L-A-I--------------S----F-G#--------
HCM273-E12_SIN681_    ------L-A----------------S------K--#--------
HCM273-A09_SIN683_    ------L-A----------------Y----G--#--------
HCM271-G03_SIN685_    ------L-D-L--------------Y----F-G#--------
HCM299-F01_SIN687_    ------L-D-V--------------W-G----L-I#--------
HCM274-A03_SIN689_    ------L-D----------------S-SS---Y-G#--------
HCM276-B04_SIN691_    ------L-D----------------V-R----S--#--------
HCM269-B10_SIN693_    ------L-D----------------V-Y----P--#--------
HCM270-A05_SIN695_    ------L-D----------------V-YS---A-F#--------
HCM268-B11_SIN697_    ------L-D----------------V-YS---T-F#--------
HCM272-F10_SIN699_    ------L-D----------------V-YS---Y-A#--------
HCM307-F04_SIN701_    ------L-D----------------V-YS---Y-G#--------
HCM274-F08_SIN703_    ------L-D------------------G----N-L#--------
HCM275-D11_SIN705_    ------L-E----------------V-S----G--#--------
HCM269-B03_SIN707_    ------L-E------------------SS---G-L#--------
HCM269-F10_SIN709_    ------L-M-----K----------S-Y----#--#--------
HCM306-E11_SIN711_    ------L-N----------------V-Y----Y-G#--------
```

TABLE 6-continued difference in CDR1 and CDR2 HCs for MMP9/2 derived from
M237-D02 at positions 25-66
(SEQ ID NOS 5054-5521, respectively, in order of appearance)
Non-standard position 58a is allowed so that isolates having
insertions appear more newly aligned.

```
HCM271-B12_SIN713_    ------L---I----------------S----F-D#--------
HCM304-E07_SIN715_    ------L---M----------------Y----G-F#--------
HCM268-H02_SIN717_    ------L--------------------S-S---A-F#--------
HCM301-B03_SIN719_    ------L--------------------S-S---G-F#--------
HCM306-D04_SIN721_    ------L--------------------S-Y---A-F#--------
HCM270-D05_SIN723_    ------L--------------------V-YS---A-F#--------
HCM269-C07_SIN725_    ------L--------------------W------F-L#--------
HCM269-G10_SIN727_    ------L--------------------S-----G-L#--------
HCM274-A12_SIN729_    ------L--------------------SS---G--#--------
HCM272-B10_SIN731_    ------L--------------------------G-F#--------
HCM302-A05_SIN733_    ------L--------------------S----A-F#--------
HCM275-D07_SIN735_    ------L--------------------Y----A-M#--------
HCM274-C03_SIN737_    ------L-Q-----------------V-Y----A--#--------
HCM272-E09_SIN739_    ------L-Q-----------------V-Y----#-F#--------
HCM298-G03_SIN741_    ------M-D-----------------V-S----G-F#--------
HCM268-E04_SIN743_    ------M-D-----------------V-Y----N-L#--------
HCM270-A08_SIN745_    ------M-D-----------------V-Y----P-F#--------
HCM268-C07_SIN747_    ------M-D-----------------V-Y----Y-A#--------
HCM268-F02_SIN749_    ------M-D-----------------V-YS---F-D#--------
HCM271-A05_SIN751_    ------M-D-----------------V-YS---P-F#--------
HCM270-C12_SIN753_    ------M-D-----------------V-YS---V-F#--------
HCM272-A02_SIN755_    ------M-D-----------------V-YS---Y-A#--------
HCM299-F03_SIN757_    ------M-D-----------------V-YS---Y-D#--------
HCM272-F05_SIN759_    ------M-D-----------------V-YS---Y-N#--------
HCM301-D12_SIN761_    ------M-D-----------------V-YS---Y-S#--------
HCM276-B10_SIN763_    ------M-D------------------SS---S-L#--------
HCM270-B05_SIN765_    ------M-M-I----------------S-Y---F-S#--------
HCM277-E11_SIN767_    ------M-N------------------S-S---A--#--------
HCM304-E02_SIN769_    ------M--II----------------S----F-G#--------
HCM307-E12_SIN771_    ------M---F----------------S----W-A#--------
HCM271-H07_SIN773_    ------M---F----------------S----W-D#--------
HCM274-C01_SIN775_    ------M---F---------------------W-D#--------
HCM268-D03_SIN777_    ------M---I----------------S----G-F#--------
HCM272-H01_SIN779_    ------M---I---------------------F-G#--------
HCM302-B06_SIN781_    ------M---L----------------S----Y-G#--------
HCM270-B11_SIN783_    ------M---T----------------S----Y-G#--------
HCM277-A10_SIN785_    ------M-S-----------------V-Y----F-D#--------
HCM302-G12_SIN787_    ------M-W-L----------------S----G-F#--------
HCM276-C01_SIN789_    ------N-W------------------S-SS---Y-G#--------
HCM276-E07_SIN791_    ------N-A------------------S----#A--#--------
HCM268-C06_SIN793_    ------N-A------------------S----S--#--------
HCM273-F02_SIN795_    ------N-D-A---------------W-SS---F-D#--------
HCM270-B01_SIN797_    ------N-D-I--------------V-S----W-S#--------
HCM276-G04_SIN799_    ------N-D-I---------------------Y-A#--------
HCM270-H01_SIN801_    ------N-D-----------------V-S----F-G#--------
HCM270-A10_SIN803_    ------N-D-----------------V-SS---Y-G#--------
HCM269-A01_SIN805_    ------N-D-----------------V-SS--#M--#--------
HCM271-E06_SIN807_    ------N-D-----------------V------A--#--------
HCM271-F01_SIN809_    ------N-D-----------------V-Y----A-F#--------
HCM271-E04_SIN811_    ------N-D-----------------V-Y----I--#--------
HCM305-H10_SIN813_    ------N-D-----------------V-Y----P--#--------
HCM272-D03_SIN815_    ------N-D-----------------V-Y----Y-V#--------
HCM270-E12_SIN817_    ------N-D-----------------V-YS---P--#--------
HCM299-A04_SIN819_    ------N-D-----------------V-YS---Y-A#--------
HCM269-C03_SIN821_    ------N-D-----------------W-SS---A-I#--------
HCM274-E09_SIN823_    ------N-D------------------SS---A-L#--------
HCM269-E04_SIN825_    ------N-E-----------------V-YS---SA-F#--------
HCM271-F07_SIN827_    ------N-I------------------S-Y---A-L#--------
HCM272-F12_SIN829_    ------N-M-I----------------S-Y---Y-G#--------
HCM272-C01_SIN831_    ------N-M-I----------------S-YS---F-S#--------
HCM275-B11_SIN833_    ------N-M------------------S-G---G-F#--------
HCM275-F12_SIN835_    ------N-M------------------S-YS---G-F#--------
HCM268-C10_SIN837_    ------N-M-----------------V-S----A--#--------
HCM303-C05_SIN839_    ------N-N-M----------------SS---Y-G#--------
HCM274-E08_SIN841_    ------N-N-----------------V-Y----P-F#--------
HCM276-D12_SIN843_    ------N-N------------------S----G-L#--------
HCM299-A02_SIN845_    ------N---F----------------S----W-S#--------
HCM268-C05_SIN847_    ------N---I----------------S----G-F#--------
HCM276-H10_SIN849_    ------N---I-----------------SS---Y-G#--------
HCM270-F10_SIN851_    ------N---I---------------------F-S#--------
HCM271-F12_SIN853_    ------N---I----------------Y----G--#--------
HCM301-H08_SIN855_    ------N---I----------------Y----#-F#--------
HCM304-D02_SIN857_    ------N--------------------S-S----S--#--------
HCM268-G02_SIN859_    ------N--------------------S------A--#--------
```

TABLE 6-continued difference in CDR1 and CDR2 HCs for MMP9/2 derived from
M237-D02 at positions 25-66
(SEQ ID NOS 5054-5521, respectively, in order of appearance)
Non-standard position 58a is allowed so that isolates having
insertions appear more newly aligned.

```
HCM271-D07_SIN861_   ------N------------------S-Y----A-F#--------
HCM269-F06_SIN863_   ------N------------------S-Y----KATY--------
HCM271-H11_SIN865_   ------N------------------S-Y----P-F#--------
HCM275-F05_SIN867_   ------N------------------S-YS---A-F#--------
HCM300-H06_SIN869_   ------N------------------V-Y----Y-A#--------
HCM274-B07_SIN871_   ------N------------------G-----G-L#--------
HCM269-A07_SIN873_   ------N------------------R-----P-W#--------
HCM269-H04_SIN875_   ------N------------------S-----G-F#--------
HCM306-H02_SIN877_   ------N------------------S-----G-L#--------
HCM299-C09_SIN879_   ------N-----------------------A-F#--------
HCM274-D06_SIN881_   ------N-------------------------M--#--------
HCM303-C12_SIN883_   ------N-S----------------V-Y----Y-S#--------
HCM273-D11_SIN885_   ------N-Y-I--------------S-----G--#--------
HCM268-G04_SIN887_   ------P-A----------------SS----G-F#--------
HCM299-D01_SIN889_   ------P-D----------------V-S----A-F#--------
HCM303-G04_SIN891_   ------P-D----------------V-S----Y-G#--------
HCM271-C05_SIN893_   ------P-D----------------V-SS---F-D#--------
HCM271-F04_SIN895_   ------P-M-F--------------S-SS---G-F#--------
HCM275-E05_SIN897_   ------P-M-I--------------S-SS---Y-G#--------
HCM269-H12_SIN899_   ------P-M-S--------------S-YS---A-F#--------
HCM270-C02_SIN901_   ------P-M----------------S-SS---G-F#--------
HCM272-F09_SIN903_   ------P-N----------------V-Y----A-F#--------
HCM275-F04_SIN905_   ------P---F--------------S-S----A--#--------
HCM305-G11_SIN907_   ------P---I-------------GS-----Y-S#--------
HCM269-C10_SIN909_   ------P---I--------------S-----F-D#--------
HCM277-A04_SIN911_   ------P---I--------------S-----G-F#--------
HCM274-G05_SIN913_   ------P---I--------------SS----G--#--------
HCM271-F10_SIN915_   ------P---I--------------SS----Y-D#--------
HCM301-E12_SIN917_   ------P------------------S-----W-D#--------
HCM271-C03_SIN919_   ------P------------------------K-F#--------
HCM274-C08_SIN921_   --------A-I--------------S-----Y-G#--------
HCM274-G04_SIN923_   --------D-I-------------GS-----S-I#--------
HCM274-B05_SIN925_   --------D---F------------V-S----H-S#--------
HCM270-D11_SIN927_   --------D----------------V-SS---A-W#--------
HCM276-A01_SIN929_   --------D----------------V-Y----P-F#--------
HCM269-F11_SIN931_   --------D----------------V-Y----T-F#--------
HCM276-B07_SIN933_   --------D----------------V-Y----Y-D#--------
HCM275-D03_SIN935_   --------D----------------V-Y---#T-F#--------
HCM268-F07_SIN937_   --------D----------------------F-D#--------
HCM268-H01_SIN939_   --------G----------------Y-----G--#--------
HCM271-B11_SIN941_   --------M-I--------------------T-G#--------
HCM270-H12_SIN943_   ----------F--------------------Y-S#--------
HCM273-C06_SIN945_   ----------I--------------------W-S#--------
HCM277-F05_SIN947_   ----------M--------------Y-----A--#--------
HCM273-C12_SIN949_   ----------M--------------Y-----G--#--------
HCM275-F11_SIN951_   ------------------------S-S----A--#--------
HCM268-C02_SIN953_   ------------------------S-Y----G-F#--------
HCM269-D01_SIN955_   ------------------------S-YS---A--#--------
HCM270-C06_SIN957_   ------------------------V-Y----F-S#--------
HCM270-D09_SIN959_   ------------------------V-Y----Y-G#--------
HCM275-F07_SIN961_   --------Q----------------V-Y----A--#--------
HCM277-D10_SIN963_   --------S-I--------------------Y-S#--------
HCM275-E02_SIN965_   --------S----------------S------A-F#--------
HCM274-H10_SIN967_   --------S----------------V-YS---A-F#--------
HCM271-C06_SIN969_   --------S----------------V-YS--SA-F#--------
HCM272-C06_SIN971_   --------W----------------V-SS---G--#--------
HCM274-C02_SIN973_   --------V----------------V-----K-F#--------
HCM274-G01_SIN975_   ------R-A-I--------------S-----F-D#--------
HCM268-F12_SIN977_   ------R-A-M--------------S-----F-D#--------
HCM268-F11_SIN979_   ------R-A----------------S-Y----G-F#--------
HCM299-E06_SIN981_   ------R-A----------------------Y-D#--------
HCM273-B12_SIN983_   ------R-D-F--------------S-S----G--#--------
HCM298-A04_SIN985_   ------R-D----------------S-SS---F-G#--------
HCM273-A11_SIN987_   ------R-D----------------V-S----A-F#--------
HCM269-A05_SIN989_   ------R-D----------------V-Y----H-M#--------
HCM270-C05_SIN991_   ------R-D----------------W-S----G-Q#--------
HCM269-F05_SIN993_   ------R-D----------------------F-S#--------
HCM277-H07_SIN995_   ------R-H----------------S-----S-L#--------
HCM275-A06_SIN997_   ------R-M-I-------------G-Y----W-D#--------
HCM268-B10_SIN999_   ------R-N----------------V-Y----A--#--------
HCM270-H03_SIN1001   ------R---F--------------S-----Y-S#--------
HCM276-A02_SIN1003   ------R---F--------------------Y-D#--------
HCM304-C09_SIN1005   ------R---I--------------Y-----G--#--------
HCM271-B05_SIN1007   ------R---V--------------S-----Y-G#--------
```

TABLE 6-continued difference in CDR1 and CDR2 HCs for MMP9/2 derived from M237-D02 at positions 25-66
(SEQ ID NOS 5054-5521, respectively, in order of appearance)
Non-standard position 58a is allowed so that isolates having insertions appear more newly aligned.

```
HCM270-C04_SIN1009   ------R-----------------S-SS---G--#--------
HCM268-G08_SIN1011   ------R-----------------S-Y----A-F#--------
HCM269-E08_SIN1013   ------R-----------------V-Y----A--F#--------
HCM276-F02_SIN1015   ------R-----------------V-Y----T-F#--------
HCM276-A10_SIN1017   ------R-----------------V-YS---Y-G#--------
HCM304-D03_SIN1019   ------R-----------------GS---G-F#--------
HCM271-D11_SIN1021   ------R------------------S----G-L#--------
HCM272-A08_SIN1023   ------R------------------S----M-S#--------
HCM269-B07_3IN1025   ------R-----------------SS---G-F#--------
HCM271-G08_SIN1027   ------R-----------------SS---G-L#--------
HCM271-A02_SIN1029   ------R------------------------A--#--------
HCM273-G11_SIN1031   ------R-----------------------F-D#--H-----
HCM299-B04_SIN1033   ------R-----------------------T--#--------
HCM275-E08_SIN1035   ------R-----------------Y----A-F#--------
HCM275-B08_SIN1037   ------R-----------------YS---K-F#--------
HCM277-G09_SIN1039   ------R-S---------------S-Y----A-F#--------
HCM271-E01_SIN1041   ------R-S---------------V-Y----Y-G#--------
HCM275-F09_SIN1043   ------R-W---------------V------A-F#--------
HCM269-D08_SIN1045   ------R-Y-M-------------S----A--#--------
HCM277-C12_SIN1047   ------S-D-I-------------W-G----S-M#--------
HCM274-F12_SIN1049   ------S-D---------------S-SS-V-A--#--------
HCM269-G01_SIN1051   ------S-D---------------V-G----G-F#--------
HCM269-F04_SIN1053   ------S-D---------------V-S----Y-G#--------
HCM269-E01_SIN1055   ------S-D---------------V-Y-------#--------
HCM269-G07_SIN1057   ------S-D---------------V-YS---F-G#--------
HCM268-C01_SIN1059   ------S-D---------------V-YS---T-F#--------
HCM268-D06_SIN1061   ------S-D---------------V-YS---Y-G#--------
HCM272-G07_SIN1063   ------S-E---------------V-YS---A-F#--------
HCM303-F07_SIN1065   ------S-E---------------SS---G--#--------
HCM275-B02_SIN1067   ------S-M-I-------------S-S----G--#--------
HCM269-C01_SIN1069   ------S-M-I-------------S-S----W-S#--------
HCM268-H04_SIN1071   ------S-M-I-------------S-Y----Y-S#--------
HCM277-H08_SIN1073   ------S-N---------------S-S----G--#--------
HCM274-B02_SIN1075   ------S---I-------------SS---F-D#--------
HCM268-E03_SIN1077   ------S---M-------------YS---G-F#--------
HCM302-G11_SIN1079   ------S-----------------S-S----G--#--------
HCM270-G08_SIN1081   ------S-----------------S-S---#M--#--------
HCM268-E08_SIN1083   ------S-----------------S-Y----G-F#--------
HCM270-E05_SIN1085   ------S-----------------SS---G--#--------
HCM271-A01_SIN1087   ------S----------------------A-F#--------
HCM270-C03_SIN1089   ------S-----------------------S-L#--------
HCM275-A09_SIN1091   ------S-----------------------Y--#--------
HCM298-D08_SIN1093   ------S-Q---------------S-Y----A-F#--------
HCM274-A09_SIN1095   ------S-S---------------V-YS---Y-G#--------
HCM269-E06_SIN1097   ------T-A-I-------------G----F-D#--------
HCM269-H06_SIN1099   ------T-A---------------S----G-F#--------
HCM276-E11_SIN1101   ------T-D-F-------------S-SS---A-F#--------
HCM271-E11_SIN1103   ------T-D-I-------------S----Y-G#--------
HCM270-A04_SIN1105   ------T-D-I-------------SS---F-D#--------
HCM268-F10_SIN1107   ------T-D---------------V-Y----P--#--------
HCM275-A02_SIN1109   ------T-D---------------SS---G-F#--------
HCM272-C08_SIN1111   ------T-E---------------SS---G-G#--------
HCM277-F06_SIN1113   ------T---F-------------S----Y-D#--------
HCM272-B07_SIN1115   ------T---I-----------------Y-G#--------
HCM276-E12_SIN1117   ------T---M-------------Y----A-F#--------
HCM299-D12_SIN1119   ------T-----------------S-S----A--#--------
HCM273-F01_SIN1121   ------T-----------------S------A--#--------
HCM271-C07_SIN1123   ------T-----------------V-YS---Y-G#--------
HCM269-H10_SIN1125   ------T-----------------S----A-F#--------
HCM268-B07_SIN1127   ------T-----------------S----G-F#--------
HCM277-G07_SIN1129   ------T----------------------Y-D#--------
HCM273-F06_SIN1131   ------T-----------------Y----G-F#--------
HCM274-E07_SIN1133   ------T-Q---------------S-YS---#-F#--------
HCM276-F04_SIN1135   ------T-S-I-------------S----F-D#--------
HCM270-A06_SIN1137   ------V-D-I-------------G----M-L#--------
HCM274-G08_SIN1139   ------V-D---------------V-Y----A--#--------
HCM274-D12_SIN1141   ------V-D---------------V-Y----Y-D#--------
HCM304-E10_SIN1143   ------V-D---------------V-YS---A-F#--------
HCM268-A02_SIN1145   ------V-D---------------V-YS---P-F#--------
HCM272-B06_SIN1147   ------V-D---------------S----F-D#--------
HCM268-D04_SIN1149   ------V-E---------------S----G-F#--------
HCM298-G07_SIN1151   ------V-N---------------S-S----G-F#--------
HCM276-E09_SIN1153   ------V-----------------S-S----A--#--------
HCM269-B04_SIN1155   ------V-----------------S-S----Y-G#--------
```

TABLE 6-continued difference in CDR1 and CDR2 HCs for MMP9/2 derived from
M237-D02 at positions 25-66
(SEQ ID NOS 5054-5521, respectively, in order of appearance)
Non-standard position 58a is allowed so that isolates having
insertions appear more newly aligned.

```
HCM299-D07_SIN1157   ------V-----------------S-SSG-#A--#--------
HCM304-G02_SIN1159   ------V-----------------W-S----G-F#--------
HCM268-D05_SIN1161   ------V-----------------W-SS---G-A#--------
HCM275-G10_SIN1163   ------V------------------------A--#--------
HCM276-G02_SIN1165   ------V--------------------Y----A--#--------
HCM274-D10_SIN1167   ------V-Q------------------V-Y----T-F#--------
HCM274-E12_SIN1169   ------V-W-I----------------------G-F#--------
HCM301-A06_SIN1171   ------W-A----------------S-S----G--#--------
HCM268-F01_SIN1173   ------W-D-F-------------S-S----A-F#--------
HCM268-D08_SIN1175   ------W-D----------------V-Y----A--#--------
HCM268-B04_SIN1177   ------W-D----------------V-Y----F-D#--------
HCM270-B04_SIN1179   ------W-D----------------V-Y----Y-G#--------
HCM268-D07_SIN1181   ------W-D----------------V-YS---A-F#--------
HCM276-F11_SIN1183   ------W-D----------------V-YS---P-F#--------
HCM274-D03_SIN1185   ------W-E---------------W-S----G-Q#--------
HCM274-H06_SIN1187   ------W-E------------------S---G--#--------
HCM270-D07_SIN1189   ------W-N----------------V-Y----G-F#--------
HCM274-F11_SIN1191   ------W-N-------------------S---F-D#--------
HCM275-B07_SIN1193   ------W---I----------------SS---Y-S#--------
HCM274-C07_SIN1195   ------W---T-----------------S---Y-G#--------
HCM275-H02_SIN1197   ------W---V----------------Y----G-F#--------
HCM276-B06_SIN1199   ------W-----------------S-S----A--#--------
HCM305-H03_SIN1201   ------W-----------------S------A--#--------
HCM272-G03_SIN1203   ------W------------------V-Y----Y-S#--------
HCM268-G05_SIN1205   ------W------------------V-YS---A-F#--------
HCM303-E08_SIN1207   ------W------------------V-YS---Y-G#--------
HCM271-C10_SIN1209   ------W------------------------A-F#--------
HCM274-B03_SIN1211   ------W----------------------------#--------
HCM277-B08_SIN1213   ------W-S----------------V-Y----G-F#--------
HCM273-D09_SIN1215   ------W-T---------------S-S----G--#--------
HCM273-C04_SIN1217   ------W-Y-I-------------S----G--#--------
HCM275-H04_SIN1219   ------Y-D-I-------------W-S----L-M#--------
HCM271-G11_SIN1221   ------Y-D-I---------------------Y-S#--------
HCM271-F08_SIN1223   ------Y-D-V-------------S----F-L#--------
HCM268-D01_SIN1225   ------Y-D---------------S-S----F-G#--------
HCM304-E11_SIN1227   ------Y-D----------------V-SS---G-F#--------
HCM301-B04_SIN1229   ------Y-D----------------V-Y----T-F#--------
HCM301-A09_SIN1231   ------Y-D----------------V-Y----Y-A#--------
HCM268-H12_SIN1233   ------Y-D------------------SS---G--#--------
HCM273-H09_SIN1235   ------Y-E------------------SS---F-S#--------
HCM303-A02_SIN1237   ------Y-G----------------V-S----G-F#--------
HCM273-G09_SIN1239   ------Y-M-I-------------G--S---F-M#--------
HCM274-A08_SIN1241   ------Y-M---------------S-SS---G-F#--------
HCM268-H06_SIN1243   ------Y-M---------------S-YS---A-F#--------
HCM273-F05_SIN1245   ------Y-N---------------S-S----G--#--------
HCM268-E02_SIN1247   ------Y---F-------------S----W-D#--------
HCM271-E09_SIN1249   ------Y---I-------------W-S----G-Q#--------
HCM275-G05_SIN1251   ------Y---V-----------------W---#--#--------
HCM277-G02_SIN1253   ------Y-----------------S------A-F#--------
HCM270-H05_SIN1255   ------Y------------------V-Y----A-F#--------
HCM273-A06_SIN1257   ------Y--------------------SS---G-H#--------
HCM276-F08_SIN1259   ------Y------------------------A-F#--------
```

Example 11

Inhibitory Activity of 19 Unique Fabs Selected from Affinity Maturation (LC+HCDR1-2-Prescreening) Against h/mMMP-2 and -9

539A-M0256-G09, 539A-M0256-A04, 539A-M0256-D03, 539A-M0265-A07, 39A-M0263-F01, 539A-M0263-F05, 539A-M0256-C09, 539A-M0256-B03, 539A-M0265-A04, 539A-M0256-A07, 539A-M0264-A09, 539A-M0265-C07, 539A-M0256-D11, 539A-M0266-E02, 539A-M0256-E10, 539A-M0256-C07, 539A-M0266-D03, 539A-M0256-E03, 539A-M0237-D02 Fabs and 539A-M0237-D02 IgG1 were tested against hMMP-9, hMMP-2, mMMP-9 and mMMP-2.

Figure 6:
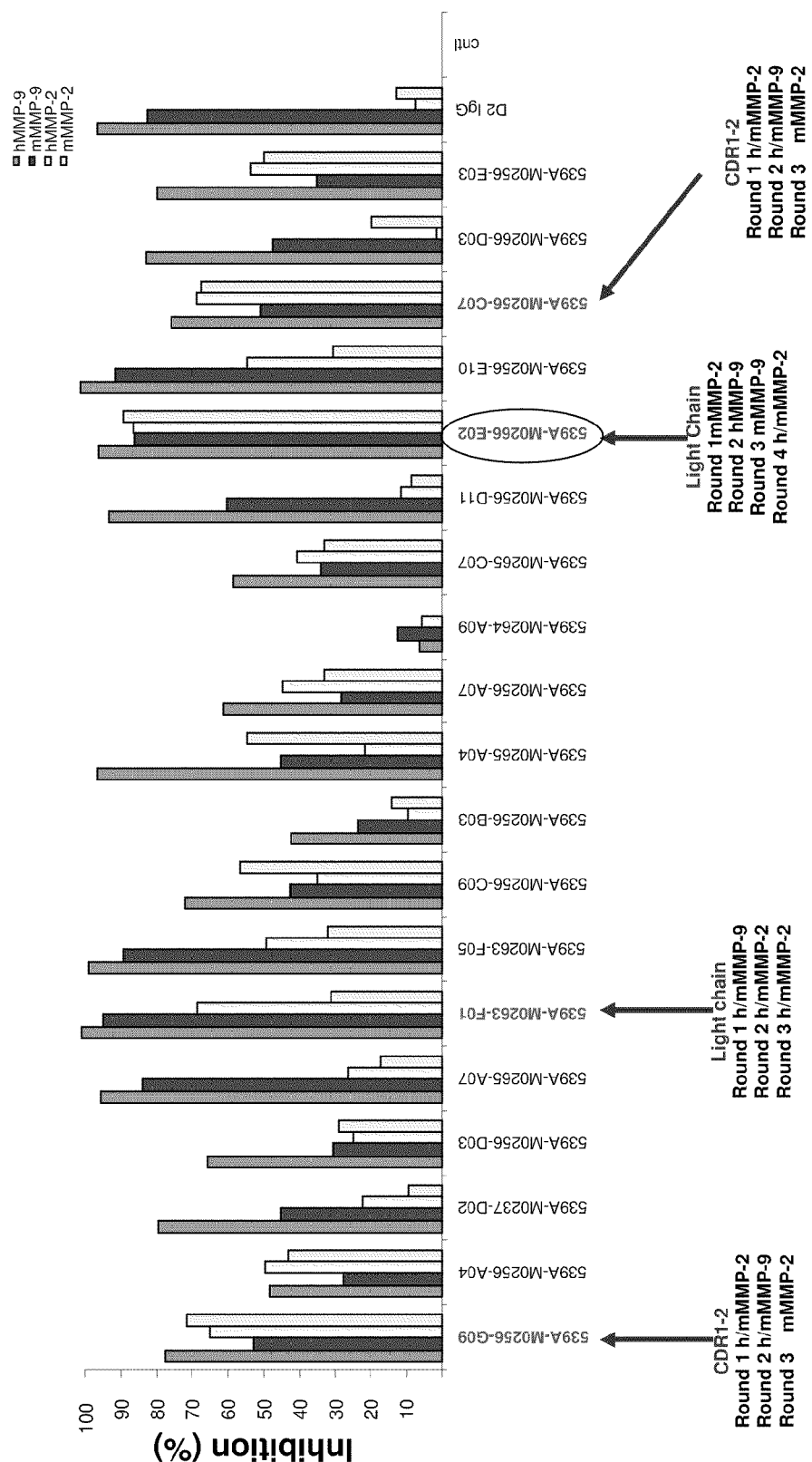
FIG. 6 is a bar graph showing inhibitory activity (%) of 19 unique Fabs selected from affinity maturation (LC+HCDR1-2-prescreening) 539A-M0256-G09, 539A-M0256-A04, 539A-M0256-D03, 539A-M0265-A07, 39A-M0263-F01, 539A-M0263-F05, 539A-M0256-C09, 539A-M0256-B03, 539A-M0265-A04, 539A-M0256-A07, 539A-M0264-A09, 539A-M0265-C07, 539A-M0256-D11, 539A-M0266-E02, 539A-M0256-E10, 539A-M0256-C07, 539A-M0266-D03, 539A-M0256-E03, 539A-M0237-D02 Fabs and 539A-M0237-D02 IgG1 against hMMP-9, hMMP-2, mMMP-9 and mMMP-2.

Results are summarized in FIG. 6.

Example 12

Kiapp ([25 μM] (nM) of 539A-M0266-E02 Against Human MMP-9, Human MMP-2, Mouse MMP-9 and Mouse MMP-2

Results are summarized in FIG. 7.

Example 13

Cross-reactivity Data for 539A-M0266-E02 Against Human MMP-1, -7, -8, 10 and -12

Results are summarized in FIG. 8.

A number of embodiments of the invention have been described. Nevertheless, it will be understood that various modifications may be made without departing from the spirit and scope of the invention. Accordingly, other embodiments are within the scope of the following claims.

SEQUENCE LISTING (5521 sequences)

SEQ ID NO: 1 - protein, 58 aa, Artificial Sequence
  Description of Artificial Sequence: Synthetic polypeptide
MHSFCAFKAETGPCRARFDRWFFNIFTRQCEEFIYGGCEGNQNRFESLEECKKMCTRD

SEQ ID NO: 2 - DNA, 363 bp, Artificial Sequence
  Description of Artificial Sequence: Synthetic polynucleotide
ttctattctcacagtgcacaagacatccagatgacccagtctccagccaccctgtctttgtctccaggggaaagagccaccctctcctgcagggccagtcagagtattagcagcttcttagcctggtaccaacagaaacctggccaggctcccaggctcctcatctatgatgcatcgtatagggccactggcatcccagccaggttcagtggcagtgggtctgggacagacttcactctcaccatcagcagcctggagcctgaagattatgcagtttattactgtcagcagcgtggcaactggcctatcaccttcggccaagggacgcggctggagattaaacgaactgtggctgcaccatct

SEQ ID NO: 3 - protein, 121 aa, Artificial Sequence
  Description of Artificial Sequence: Synthetic polypeptide
FYSHSAQDIQMTQSPATLSLSPGERATLSCRASQSISSFLAWYQQKPGQAPRLLIYDASYRATGIPARFSGSGSGTDFTLTISSLEPEDYAVYYCQQRGNWPITFGQGTRLEIKRTVAAPS

SEQ ID NO: 4 - DNA, 486 bp, Artificial Sequence
  Description of Artificial Sequence: Synthetic polynucleotide
atgaagaagctcctctttgctatcccgctcgtcgttccttttgtggcccagccggccatggccgaagttcaattgttagagtctggtggcggtcttgttcagcctggtggttctttacgtctttcttgcgctgcttccggattcactttctctcagtaccctatgtggtgggttcgccaagctcctggtaaaggtttggagtgggtttcttatatcgttccttctggtggccgtacttattatgctgactccgttaaaggtcgcttcactatctctagagacaactctaagaatactctctacttgcagatgaacagcttaagggctgaggacacggccgtgtattactgtgcgaaagatcgggcctacggtgattacgtgggctggaacggttttgactactggggccagggcaccctggtcaccgtctcaagcgcctccaccaagggcccatcggtcttcccgctagcaccctcctccaagagc

SEQ ID NO: 5 - protein, 162 aa, Artificial Sequence
  Description of Artificial Sequence: Synthetic polypeptide
MKKLLFAIPLVVPFVAQPAMAEVQLLESGGGLVQPGGSLRLSCAASGFTFSQYPMWWVRQAPGKGLEWVSYIVPSGGRTYYADSVKGRFTISRDNSKNTLYLQMNSLRAEDTAVYYCAKDRAYGDYVGWNGFDYWGQGTLVTVSSASTKGPSVFPLAPSSKS

SEQ ID NO: 6 - protein, 108 aa, Artificial Sequence
  Description of Artificial Sequence: Synthetic polypeptide
QDIQMTQSPATLSLSPGERASLSCRASQNVARFLAWYQQKPGQAPRLLIYSASNRATGVPDRFSGSGSGTDFTLTISSLEPEDFAVYFCQQRGNWPITFGQGTRLEIK

SEQ ID NO: 7 - protein, 124 aa, Artificial Sequence
  Description of Artificial Sequence: Synthetic polypeptide
EVQLLESGGGLVQPGGSLRLSCAASGFTFSQYPMWWVRQAPGKGLEWVSYIVPSGGRTYYADSVKGRFTISRDNSKNTLYLQMNSLRAEDTAVYYCAKDRAYGDYVGWNGFDYWGQGTLVTVSS

SEQ ID NO: 8 - protein, 108 aa, Artificial Sequence
  Description of Artificial Sequence: Synthetic polypeptide
QDIQMTQSPATLSLSPGERATLSCRASQNVHTYLAWYQQKPGQAPRLLISEASNRATGVPARFTGSGSGIDFSLSISSLEPEDFAIYYCQQRGGWPITFGGGTKVEIK

SEQ ID NO: 9 - protein, 124 aa, Artificial Sequence; identical to SEQ ID NO: 7
  Description of Artificial Sequence: Synthetic polypeptide

SEQ ID NO: 10 - protein, 108 aa, Artificial Sequence
  Description of Artificial Sequence: Synthetic polypeptide
QDIQMTQSPATLSLSPGERATLSCRASQSISSFLAWYQQKPGQAPRLLIYDASYRATGIPARFSGSGSGTDFTLTISSLEPEDYAVYYCQQRGNWPITFGQGTRLEIK

SEQ ID NO: 11 - protein, 124 aa, Artificial Sequence
  Description of Artificial Sequence: Synthetic polypeptide
EVQLLESGGGLVQPGGSLRLSCAASGFTFSVYPMIWVRQAPGKGLEWVSYISPSGGFTGYADSVKGRFTISRDNSKNTLYLQMNSLRAEDTAVYYCAKDRAYGDYVGWNGFDYWGQGTLVTVSS

SEQ ID NO: 12 - protein, 108 aa, Artificial Sequence; identical to SEQ ID NO: 10
  Description of Artificial Sequence: Synthetic polypeptide

SEQ ID NO: 13 - protein, 124 aa, Artificial Sequence
  Description of Artificial Sequence: Synthetic polypeptide
EVQLLESGGGLVQPGGSLRLSCAASGFTFSDYPMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 14 - protein, 108 aa, Artificial Sequence; identical to SEQ ID NO: 10
  Description of Artificial Sequence: Synthetic polypeptide

SEQ ID NO: 15 - protein, 124 aa, Artificial Sequence
  Description of Artificial Sequence: Synthetic polypeptide
EVQLLESGGGLVQPGGSLRLSCAASGFTFSTYPMIWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 16 - protein, 108 aa, Artificial Sequence; identical to SEQ ID NO: 10
  Description of Artificial Sequence: Synthetic polypeptide

SEQ ID NO: 17 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSVIYSSGGPTFYADSVKGRFTISRDNSKNTLYLQMNSLRAEDTAVYYCAKDRAYGDYVGWNGFDYWGQGTLVTVSS

SEQ ID NO: 18 - protein, 108 aa, Artificial Sequence; identical to SEQ ID NO: 10
  Description of Artificial Sequence: Synthetic polypeptide

SEQ ID NO: 19 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSSISPSGGATYYADSVKGRFTISRDNSKNTLYLQMNSLRAEDTAVYYCAKDRAYGDYVGWNGFDYWGQGTLVTVSS

SEQ ID NO: 20 - protein, 108 aa, Artificial Sequence; identical to SEQ ID NO: 10
  Description of Artificial Sequence: Synthetic polypeptide

SEQ ID NO: 21 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 22 - protein, 108 aa, Artificial Sequence; identical to SEQ ID NO: 10
  Description of Artificial Sequence: Synthetic polypeptide

SEQ ID NO: 23 - protein, 124 aa, Artificial Sequence
  Description of Artificial Sequence: Synthetic polypeptide
EVQLLESGGGLVQPGGSLRLSCAASGFTFSHYDMLWVRQAPGKGLEWVSYISSSGGYTGYADSVKGRFTISRDNSKNTLYLQMNSLRAEDTAVYYCAKDRAYGDYVGWNGFDYWGQGTLVTVSS

SEQ ID NO: 24 - protein, 108 aa, Artificial Sequence; identical to SEQ ID NO: 10
  Description of Artificial Sequence: Synthetic polypeptide

SEQ ID NO: 25 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 26 - protein, 108 aa, Artificial Sequence; identical to SEQ ID NO: 10
  Description of Artificial Sequence: Synthetic polypeptide

SEQ ID NO: 27 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSYISSSGGATFYADSVKGRFTISRDNSKNTLYLQMNSLRAEDTAVYYCAKDRAYGDYVGWNGFDYWGQGTLVTVSS

SEQ ID NO: 28 - protein, 108 aa, Artificial Sequence; identical to SEQ ID NO: 10
  Description of Artificial Sequence: Synthetic polypeptide

SEQ ID NO: 29 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYISPSGGFTSYADSVKGRFTISRDNSKNTLYLQMNSLRAEDTAVYYCAKDRAYGDYVGWNGFDYWGQGTLVTVSS

SEQ ID NO: 30 - protein, 108 aa, Artificial Sequence
  Description of Artificial Sequence: Synthetic polypeptide
QDIQMTQSPATLSLSPGETAILSCRASQSVGRFLAWYQQKPGQAPRLLIYGASSRATGIPDRFSGSGSGTDFSLTISRLEPEDFAVYYCQQRGNWPITFGQGTRLEIK

SEQ ID NO: 31 - protein, 124 aa, Artificial Sequence; identical to SEQ ID NO: 7
  Description of Artificial Sequence: Synthetic polypeptide

SEQ ID NO: 32 - protein, 108 aa, Artificial Sequence
  Description of Artificial Sequence: Synthetic polypeptide
QDIQMTQSPATLSVSPGERATLSCRASQNIGSDLAWYQHKPGQGPRLLIYGASSRATGIPDRFSGSGSGTDFTLTISSLEPEDFAVYFCQQRGNWPITFGQGTRLEIK

SEQ ID NO: 33 - protein, 124 aa, Artificial Sequence; identical to SEQ ID NO: 7
  Description of Artificial Sequence: Synthetic polypeptide

SEQ ID NO: 34 - protein, 108 aa, Artificial Sequence
  Description of Artificial Sequence: Synthetic polypeptide
QDIQMTQSPGTLSLSPGERATLSCRASQSVGNFLAWYQQKPGQAPRLLIYGASNRATGIPDRFSGSGSGTDFTLTISRLEPEDFAVYFCQQRGNWPITFGQGTRLEIK

SEQ ID NO: 35 - protein, 124 aa, Artificial Sequence; identical to SEQ ID NO: 7
  Description of Artificial Sequence: Synthetic polypeptide

SEQ ID NO: 36 - protein, 108 aa, Artificial Sequence
  Description of Artificial Sequence: Synthetic polypeptide
QDIQMTQSPSSVSASTGDRVIISCRASQVIFSGLAWYQQKPGKAPKLLISAASNLQSGVPARFSGSGSGTYFTLTISSLQPEDFATYYCQQAQTFPFTFGPGTKVDVQ

SEQ ID NO: 37 - protein, 124 aa, Artificial Sequence; identical to SEQ ID NO: 7
  Description of Artificial Sequence: Synthetic polypeptide

SEQ ID NO: 38 - protein, 108 aa, Artificial Sequence
  Description of Artificial Sequence: Synthetic polypeptide
QDIQMTQSPSSVSASVGDRVTITCRASQNIGRWLAWYQQKPGQAPNLLIYGASSLQTGVPSRFSGSGSGTDFSLTISSLQPEDFAVYYCQQRRKWPVTFGGGTKVEIK

SEQ ID NO: 39 - protein, 124 aa, Artificial Sequence; identical to SEQ ID NO: 7
  Description of Artificial Sequence: Synthetic polypeptide

SEQ ID NO: 40 - protein, 108 aa, Artificial Sequence
  Description of Artificial Sequence: Synthetic polypeptide
QDIQMTQSPVTLSVSPGERATLSCRASQNIGSDLAWYQQQPGQAPRLLIYRASFRATGIPARFSGSGSGTDFTLTISSLQSEDFAVYYCQQRGNWPPTFGGGTKVEIR

SEQ ID NO: 41 - protein, 124 aa, Artificial Sequence; identical to SEQ ID NO: 7
  Description of Artificial Sequence: Synthetic polypeptide

SEQ ID NO: 42 - protein, 108 aa, Artificial Sequence
  Description of Artificial Sequence: Synthetic polypeptide
QDIQMTQFPATLSLSPGERATLSCRASQSISSFLAWYQQKPGQAPRLLIYDASYRATGIPARFSGSGSGTDFTLTISSLEPEDYAVYYCQQRGNWPITFGQGTRLEIK

SEQ ID NO: 43 - protein, 124 aa, Artificial Sequence; identical to SEQ ID NO: 7
  Description of Artificial Sequence: Synthetic polypeptide

SEQ ID NO: 44 - protein, 108 aa, Artificial Sequence
  Description of Artificial Sequence: Synthetic polypeptide
QDIQMTQSPAALSLSPGERATLSCRASQSVSSDLAWYQQKPGQAPRLLIYGASTRATGIPARFSGSRSGTAFTLTISSLEPEDFAVYYCQQRSNWPVTFGQGTKLEIK

SEQ ID NO: 45 - protein, 124 aa, Artificial Sequence; identical to SEQ ID NO: 7
  Description of Artificial Sequence: Synthetic polypeptide

SEQ ID NO: 46 - protein, 108 aa, Artificial Sequence
  Description of Artificial Sequence: Synthetic polypeptide
QDIQMTQSPAFLSASLGDRVTITCRATQGIGTFLAWYQQKAGRAPKLLIYGASTLQSGVPSRFSGSGSGTEFTLTISSLQPEDFATYYCQQRYTWPITFGQGTRLEIR

SEQ ID NO: 47 - protein, 124 aa, Artificial Sequence; identical to SEQ ID NO: 7
  Description of Artificial Sequence: Synthetic polypeptide

SEQ ID NO: 48 - protein, 108 aa, Artificial Sequence
  Description of Artificial Sequence: Synthetic polypeptide
QDIQMTQSPATLPVSPGETVTLSCTASQSVGSHLAWYQQRPNQAPRLLIYDTSSRATGIPARFSGSGSGTDFTLTITSLEPEDFAVYYCQQRRSWPLTFGGGTKVEIK

SEQ ID NO: 49 - protein, 124 aa, Artificial Sequence; identical to SEQ ID NO: 7
  Description of Artificial Sequence: Synthetic polypeptide

SEQ ID NO: 50 - protein, 108 aa, Artificial Sequence
  Description of Artificial Sequence: Synthetic polypeptide
QDIQMTQSPATLSASPGERATLSCRASQSVSSDLAWYQQKPGQAPRLLIYGASTRATGIPARFSGSGSGTEFTLTISSLEPEDFALYYCQQRAYWPVSFGGGTKVEIK

SEQ ID NO: 51 - protein, 124 aa, Artificial Sequence; identical to SEQ ID NO: 7
  Description of Artificial Sequence: Synthetic polypeptide

SEQ ID NO: 52 - protein, 108 aa, Artificial Sequence
  Description of Artificial Sequence: Synthetic polypeptide
QDIQMTQSPATLSFSAGERATLSCRASQHIYTSLAWYQHKAGQAPRLLIYEASYRATGIPARFSGSGSGRDFTLTISSLEPEDVAVYYCQQRGSWPITFGQGTRLEIK

SEQ ID NO: 53 - protein, 124 aa, Artificial Sequence; identical to SEQ ID NO: 7
  Description of Artificial Sequence: Synthetic polypeptide

SEQ ID NO: 54 - protein, 108 aa, Artificial Sequence
  Description of Artificial Sequence: Synthetic polypeptide
QDIQMTQSPATLSLSAGERATLSCRASQSVSSYLAWYQQKPGQAPRLLIYGASTRATGIPARFSGGGSGTEFTLTISSLEPEDFAVYFCQQRGFWPITFGQGTRLEIK

SEQ ID NO: 55 - protein, 124 aa, Artificial Sequence; identical to SEQ ID NO: 7
  Description of Artificial Sequence: Synthetic polypeptide

SEQ ID NO: 56 - protein, 108 aa, Artificial Sequence
  Description of Artificial Sequence: Synthetic polypeptide
QDIQMTQSPATLSLSPGDRATLSCRASQSVSSYLAWYQQKPGQAPRLLIYGASNRATGIPARFSGSGSGTDFTLTISSLEPEDYAVYYCQQRGNWPITFGQGTRLEIK

SEQ ID NO: 57 - protein, 124 aa, Artificial Sequence; identical to SEQ ID NO: 7
  Description of Artificial Sequence: Synthetic polypeptide

SEQ ID NO: 58 - protein, 107 aa, Artificial Sequence
  Description of Artificial Sequence: Synthetic polypeptide
QDIQMTQSPATLSLSPGDWATLSCRASQSVSSVAWYQQKPGQAPRLLIYDTSNRATGIPDRFSGSGSGTDFTLTISRLEPEDFAVYYCQQRTKWPITFGQGTRLEIK

SEQ ID NO: 59 - protein, 124 aa, Artificial Sequence; identical to SEQ ID NO: 7
  Description of Artificial Sequence: Synthetic polypeptide

SEQ ID NO: 60 - protein, 108 aa, Artificial Sequence
  Description of Artificial Sequence: Synthetic polypeptide
QDIQMTQSPATLSLSPGEGATLSCRASESVGMYIAWYQQKPGQAPRLLMYGASNRATGIPARFRGSGSGTDFTLTISSLEPEDFAVYYCQQRGNWPITFGQGTRLEIK

SEQ ID NO: 61 - protein, 124 aa, Artificial Sequence; identical to SEQ ID NO: 7
  Description of Artificial Sequence: Synthetic polypeptide

SEQ ID NO: 62 - protein, 109 aa, Artificial Sequence
  Description of Artificial Sequence: Synthetic polypeptide
QDIQMTQSPATLSLSPGERATLSCGASQSVSSSYLAWYQQKPGLAPRLLIYDASSRATGIPDRFSGSGSGTDFTLTISRLEPEDFAVYYCQQYGSSPWTFGPGTTLDFN

SEQ ID NO: 63 - protein, 124 aa, Artificial Sequence; identical to SEQ ID NO: 7
  Description of Artificial Sequence: Synthetic polypeptide

SEQ ID NO: 64 - protein, 108 aa, Artificial Sequence
  Description of Artificial Sequence: Synthetic polypeptide
QDIQMTQSPATLSLSPGERATLSCRASPSISNFLAWYQQRPGQAPRLLIYGASNRATGVPARFSGSGSGTDFNLTISSVEPEDFAVYYCQQRRSWPPTFGQGTKLETK

SEQ ID NO: 65 - protein, 124 aa, Artificial Sequence; identical to SEQ ID NO: 7
  Description of Artificial Sequence: Synthetic polypeptide

SEQ ID NO: 66 - protein, 108 aa, Artificial Sequence
  Description of Artificial Sequence: Synthetic polypeptide
QDIQMTQSPATLSLSPGERATLSCRASQNIGGYLAWYQQKPGQAPRLLIYGASNRATGVPARFSGSGSGTDFSLIISSLETEDFAVYYCQQRSNWPPTFGGGTKVEIK

SEQ ID NO: 67 - protein, 124 aa, Artificial Sequence; identical to SEQ ID NO: 7
  Description of Artificial Sequence: Synthetic polypeptide

SEQ ID NO: 68 - protein, 109 aa, Artificial Sequence
  Description of Artificial Sequence: Synthetic polypeptide
QDIQMTQSPATLSLSPGERATLSCRASQNVANYLDWYQQKPGQAPRLLIYDGSNRATGVPDRFRGSGSETDFTLIISSLEPEDFAVYYCQQRHSWPPITFGQGTRLQIK

SEQ ID NO: 69 - protein, 124 aa, Artificial Sequence; identical to SEQ ID NO: 7
  Description of Artificial Sequence: Synthetic polypeptide

SEQ ID NO: 70 - protein, 108 aa, Artificial Sequence
  Description of Artificial Sequence: Synthetic polypeptide
QDIQMTQSPATLSLSPGERATLSCRASQNVHTYLAWYQQKPGQAPRLLISEASNRATGVPARFTGSGSGTDFTLSISSLEPEDFAIYYCQQRGGWPITFGGGTKVEIK

SEQ ID NO: 71 - protein, 124 aa, Artificial Sequence; identical to SEQ ID NO: 7
  Description of Artificial Sequence: Synthetic polypeptide

SEQ ID NO: 72 - protein, 108 aa, Artificial Sequence
  Description of Artificial Sequence: Synthetic polypeptide
QDIQMTQSPATLSLSPGERATLSCRASQSIGNHLAWYQQKSGQAPRLLIYDASNRATGIPARFSGGGSGTDFTLTISSLEPEDFAVYFCQQRGNWPITFGQGTRLEIK

SEQ ID NO: 73 - protein, 124 aa, Artificial Sequence; identical to SEQ ID NO: 7
  Description of Artificial Sequence: Synthetic polypeptide

SEQ ID NO: 74 - protein, 108 aa, Artificial Sequence
  Description of Artificial Sequence: Synthetic polypeptide
QDIQMTQSPATLSLSPGERATLSCRASQSISSFLAWYQQKPGQAPRLLIYDASYRATGIPARFSGSGSGTDFTLTISSLEPEDYAVYYCQQRGNWPITFGQGTKVEIK

SEQ ID NO: 75 - protein, 124 aa, Artificial Sequence; identical to SEQ ID NO: 7
  Description of Artificial Sequence: Synthetic polypeptide

SEQ ID NO: 76 - protein, 108 aa, Artificial Sequence
  Description of Artificial Sequence: Synthetic polypeptide
QDIQMTQSPATLSLSPGERATLSCRASQSISSFLAWYQQKPGQAPRLLIYGASSRARGTPDRFSGSGSGTDFTLTISSLEPEDYAVYYCQQRGNWPITFGQGTRLEIK

SEQ ID NO: 77 - protein, 124 aa, Artificial Sequence; identical to SEQ ID NO: 7
  Description of Artificial Sequence: Synthetic polypeptide

SEQ ID NO: 78 - protein, 108 aa, Artificial Sequence
  Description of Artificial Sequence: Synthetic polypeptide
QDIQMTQSPATLSLSPGERATLSCRASQSISSFLAWYQQKPGQAPRLLIYGASTRATGIPARFSGSGSGTDFTLTISSLEPEDYAVYYCQQRGNWPITFGQGTRLEIK

SEQ ID NO: 79 - protein, 124 aa, Artificial Sequence; identical to SEQ ID NO: 7
  Description of Artificial Sequence: Synthetic polypeptide

SEQ ID NO: 80 - protein, 108 aa, Artificial Sequence
  Description of Artificial Sequence: Synthetic polypeptide
QDIQMTQSPATLSLSPGERATLSCRASQSISSHLAWYQQKPGQAPRLVISGASSRATGIPDRFSGSGSGTDFTLTISRLEPEDYAVYYCQQRGNWPITFGQGTRLEIK

SEQ ID NO: 81 - protein, 124 aa, Artificial Sequence; identical to SEQ ID NO: 7
  Description of Artificial Sequence: Synthetic polypeptide

SEQ ID NO: 82 - protein, 108 aa, Artificial Sequence
  Description of Artificial Sequence: Synthetic polypeptide
QDIQMTQSPATLSLSPGERATLSCRASQSISTSLAWYQQKPGQAPRLLIYDASNRAAVIPARFSGSGSGTDFTLTISNLEPEDSAVYYCQQRGAWPLTFGGGTKVEIK

SEQ ID NO: 83 - protein, 124 aa, Artificial Sequence; identical to SEQ ID NO: 7
  Description of Artificial Sequence: Synthetic polypeptide

SEQ ID NO: 84 - protein, 109 aa, Artificial Sequence
  Description of Artificial Sequence: Synthetic polypeptide
QDIQMTQSPATLSLSPGERATLSCRASQSLGRSDLAWYQQKPGQAPRLLIFGVSNRVTGTPDRFSGSGSGTDFSLTISSLEPEDFAVYYCQQRSNWPPTFGGGTKLEIK

SEQ ID NO: 85 - protein, 124 aa, Artificial Sequence; identical to SEQ ID NO: 7
  Description of Artificial Sequence: Synthetic polypeptide

SEQ ID NO: 86 - protein, 109 aa, Artificial Sequence
  Description of Artificial Sequence: Synthetic polypeptide
QDIQMTQSPATLSLSPGERATLSCRASQSLGRSDLAWYQQKPGQAPRLLIFGVSNRVTGTPDRFSGSGSGTDFTLTIGSLEPEDFAVYYCQQRSTWPITFGQGTRLEIK

SEQ ID NO: 87 - protein, 124 aa, Artificial Sequence; identical to SEQ ID NO: 7
  Description of Artificial Sequence: Synthetic polypeptide

SEQ ID NO: 88 - protein, 108 aa, Artificial Sequence
  Description of Artificial Sequence: Synthetic polypeptide
QDIQMTQSPATLSLSPGERATLSCRASQSLGSFLAWYQQKPGQAPRLLIYGASYRATGIPARFSGSGSGTDFTLTISSLEPEDYAVYYCQQRGNWPITFGQGTRLEIK

SEQ ID NO: 89 - protein, 124 aa, Artificial Sequence; identical to SEQ ID NO: 7
  Description of Artificial Sequence: Synthetic polypeptide

SEQ ID NO: 90 - protein, 108 aa, Artificial Sequence
  Description of Artificial Sequence: Synthetic polypeptide
QDIQMTQSPATLSLSPGERATLSCRASQSVDSYLAWYQQKPGQAPRLLIYDASNRATGIPARFSGSGSGTDFTLTISNLEPEDFAVYYCQHRRSWPLTFGGGTKVEIK

SEQ ID NO: 91 - protein, 124 aa, Artificial Sequence; identical to SEQ ID NO: 7
  Description of Artificial Sequence: Synthetic polypeptide

SEQ ID NO: 92 - protein, 108 aa, Artificial Sequence
  Description of Artificial Sequence: Synthetic polypeptide
QDIQMTQSPATLSLSPGERATLSCRASQSVDSYLAWYQQKPGQAPRLLIYGASNRATGIPARFSGSGSGTDFTLTIASLEPEDFAVYYCQQRRKWPVTFGGGTKVEIK

SEQ ID NO: 93 - protein, 124 aa, Artificial Sequence; identical to SEQ ID NO: 7
  Description of Artificial Sequence: Synthetic polypeptide

SEQ ID NO: 94 - protein, 108 aa, Artificial Sequence
  Description of Artificial Sequence: Synthetic polypeptide
QDIQMTQSPATLSLSPGERATLSCRASQSVGGDIAWYQQKPGQAPRLLMYGASNRATGIPARFSGSGSGTDFTLTISSLEPEDFAVYYCQQRSYWPVTFGGGTRVEIK

SEQ ID NO: 95 - protein, 124 aa, Artificial Sequence; identical to SEQ ID NO: 7
  Description of Artificial Sequence: Synthetic polypeptide

SEQ ID NO: 96 - protein, 108 aa, Artificial Sequence
  Description of Artificial Sequence: Synthetic polypeptide
QDIQMTQSPATLSLSPGERATLSCRASQSVGRDLAWYQQKPGQAPRLLIYGATTRATGIPARFSGSGSGTDFTLTISSLEPEDFAVYFCQQRGNWPITFGQGTRLEIK

SEQ ID NO: 97 - protein, 124 aa, Artificial Sequence; identical to SEQ ID NO: 7
  Description of Artificial Sequence: Synthetic polypeptide

SEQ ID NO: 98 - protein, 108 aa, Artificial Sequence
  Description of Artificial Sequence: Synthetic polypeptide
QDIQMTQSPATLSLSPGERATLSCRASQSVGSDLAWYQQKHGQAPRLLMYGASTRATGIPARFSGSGSGTDFTLTISSLEPEDFAVYFCQQRGNWPITFGQGTRLEIK

SEQ ID NO: 99 - protein, 124 aa, Artificial Sequence; identical to SEQ ID NO: 7
  Description of Artificial Sequence: Synthetic polypeptide

SEQ ID NO: 100 - protein, 108 aa, Artificial Sequence
  Description of Artificial Sequence: Synthetic polypeptide
QDIQMTQSPATLSLSPGERATLSCRASQSVGSFLAWYQQKPGQAPRLLIYGASNRATGIPPRFSGSGSGTDFTLTISSLEPEDSAAYYCQQRGNWPITFGQGTRLEIK

SEQ ID NO: 101 - protein, 124 aa, Artificial Sequence; identical to SEQ ID NO: 7
  Description of Artificial Sequence: Synthetic polypeptide

SEQ ID NO: 102 - protein, 108 aa, Artificial Sequence
  Description of Artificial Sequence: Synthetic polypeptide
QDIQMTQSPATLSLSPGERATLSCRASQSVGSQLAWYQQKPGQAPRLLIYDASYRATGIPVRFSGSGSGTDFTLTISSLEPEDYAVYYCQQRGNWPITFGQGTRLEIK

SEQ ID NO: 103 - protein, 124 aa, Artificial Sequence; identical to SEQ ID NO: 7
  Description of Artificial Sequence: Synthetic polypeptide

SEQ ID NO: 104 - protein, 108 aa, Artificial Sequence
  Description of Artificial Sequence: Synthetic polypeptide
QDIQMTQSPATLSLSPGERATLSCRASQSVGTHLAWYQQKPGQAPRLLIYGASTRATGIPARFSGSGSGTEFTLTISSLQSEDFAIYHCQQRRSWPITFGQGTRLEIK

SEQ ID NO: 105 - protein, 124 aa, Artificial Sequence; identical to SEQ ID NO: 7
  Description of Artificial Sequence: Synthetic polypeptide

SEQ ID NO: 106 - protein, 108 aa, Artificial Sequence
  Description of Artificial Sequence: Synthetic polypeptide
QDIQMTQSPATLSLSPGERATLSCRASQSVNHFLAWYQQKPGQAPRLLIYGASNRATGVPARFNGTGSGTDFTLTISSLEPEDFAVYYCQQRGSWPITFGQGTRLEIK

SEQ ID NO: 107 - protein, 124 aa, Artificial Sequence; identical to SEQ ID NO: 7
  Description of Artificial Sequence: Synthetic polypeptide

SEQ ID NO: 108 - protein, 108 aa, Artificial Sequence
  Description of Artificial Sequence: Synthetic polypeptide
QDIQMTQSPATLSLSPGERATLSCRASQSVNSFLAWYQQKAGQAPRLLIYDASNRATGIPARFSGSGSGTDFTLTISSLEPEDFAVYYCQQRSNWPITFGQGTRLEIR

SEQ ID NO: 109 - protein, 124 aa, Artificial Sequence; identical to SEQ ID NO: 7
  Description of Artificial Sequence: Synthetic polypeptide

SEQ ID NO: 110 - protein, 108 aa, Artificial Sequence
  Description of Artificial Sequence: Synthetic polypeptide
QDIQMTQSPATLSLSPGERATLSCRASQSVNSYLAWYQQKPGQAPRLLIYDASNRATGIPARFSGSGSGTDFTLTISSLEPEDFAVYYCQQRGYWPPSFGGGTKVEIL

SEQ ID NO: 111 - protein, 124 aa, Artificial Sequence; identical to SEQ ID NO: 7
  Description of Artificial Sequence: Synthetic polypeptide

SEQ ID NO: 112 - protein, 108 aa, Artificial Sequence
  Description of Artificial Sequence: Synthetic polypeptide
QDIQMTQSPATLSLSPGERATLSCRASQSVSNFLAWYQQKPGQAPRLLIYGASSRATGIPDRFSGSGSGTDFTLTISSLEPEDFAVYYCQQRGNWPITFGQGTRLEIK

SEQ ID NO: 113 - protein, 124 aa, Artificial Sequence; identical to SEQ ID NO: 7
  Description of Artificial Sequence: Synthetic polypeptide

SEQ ID NO: 114 - protein, 108 aa, Artificial Sequence
  Description of Artificial Sequence: Synthetic polypeptide
QDIQMTQSPATLSLSPGERATLSCRASQSVSNYLAWYQQKRGQAPRLLIYGASTRATGIPARFSGSGSGTEFTLTISSLQSEDFAVYYCQQRGNWPITFGQGTRLEIK

SEQ ID NO: 115 - protein, 124 aa, Artificial Sequence; identical to SEQ ID NO: 7
  Description of Artificial Sequence: Synthetic polypeptide

SEQ ID NO: 116 - protein, 108 aa, Artificial Sequence
  Description of Artificial Sequence: Synthetic polypeptide
QDIQMTQSPATLSLSPGERATLSCRASQSVSRYLAWYQQKPGQAPRLLIYDASSRATGVPARFSGGGSGTDFTLTISSLEPEDFAVYYCHQRSSWPITFGQGTRLEIK

SEQ ID NO: 117 - protein, 124 aa, Artificial Sequence; identical to SEQ ID NO: 7
  Description of Artificial Sequence: Synthetic polypeptide

SEQ ID NO: 118 - protein, 108 aa, Artificial Sequence
  Description of Artificial Sequence: Synthetic polypeptide
QDIQMTQSPATLSLSPGERATLSCRASQSVSRYLAWYQQRPGQAPRLLIYDASNRATGIPARFSGSGSGTDFTLTISSLEPEDFAVYYCQQRINWPLTFGGGTKVEIK

SEQ ID NO: 119 - protein, 124 aa, Artificial Sequence; identical to SEQ ID NO: 7
  Description of Artificial Sequence: Synthetic polypeptide

SEQ ID NO: 120 - protein, 108 aa, Artificial Sequence
  Description of Artificial Sequence: Synthetic polypeptide
QDIQMTQSPATLSLSPGERATLSCRASQSVSSFLAWYQQKPGQAPRLLIYHASNRATGIPARFRGSGSGTDFTLTISSLEPEDFAVYYCQQRGNWPITFGQGTRLEIK

SEQ ID NO: 121 - protein, 124 aa, Artificial Sequence; identical to SEQ ID NO: 7
  Description of Artificial Sequence: Synthetic polypeptide

SEQ ID NO: 122 - protein, 108 aa, Artificial Sequence
  Description of Artificial Sequence: Synthetic polypeptide
QDIQMTQSPATLSLSPGERATLSCRASQSVSSFLAWYQQKPGRAPRLVIYDASNRASGIPARFSGSGSGADFTLTITSLEPEDFAVYYCQQRANWPLTFGGGTRVEIK

SEQ ID NO: 123 - protein, 124 aa, Artificial Sequence; identical to SEQ ID NO: 7
  Description of Artificial Sequence: Synthetic polypeptide

SEQ ID NO: 124 - protein, 108 aa, Artificial Sequence
  Description of Artificial Sequence: Synthetic polypeptide
QDIQMTQSPATLSLSPGERATLSCRASQSVSSHLAWYQQKPGQAPRLLIYGASSRATGIPDRFSGSGSGTDFTLTISRLEPEDFAVYYCQQRGNWPITFGQGTRLEIK

SEQ ID NO: 125 - protein, 124 aa, Artificial Sequence; identical to SEQ ID NO: 7
  Description of Artificial Sequence: Synthetic polypeptide

SEQ ID NO: 126 - protein, 108 aa, Artificial Sequence
  Description of Artificial Sequence: Synthetic polypeptide
QDIQMTQSPATLSLSPGERATLSCRASQSVSSYLAWYKQKPGQAPRLLIYDASNRATGIPARFSGSGSGTDFTLTISSLEPEDFAVYFCQQRGNWPITFGQGTRLEIK

SEQ ID NO: 127 - protein, 124 aa, Artificial Sequence; identical to SEQ ID NO: 7
  Description of Artificial Sequence: Synthetic polypeptide

SEQ ID NO: 128 - protein, 108 aa, Artificial Sequence
  Description of Artificial Sequence: Synthetic polypeptide
QDIQMTQSPATLSLSPGERATLSCRASQSVSSYLAWYKQKPGQAPRLLIYGASNRATGIPARFSGSGSGTDFTLTISSLEPEDFAVYFCQQRGNWPITFGQGTRLEIK

SEQ ID NO: 129 - protein, 124 aa, Artificial Sequence; identical to SEQ ID NO: 7
  Description of Artificial Sequence: Synthetic polypeptide

SEQ ID NO: 130 - protein, 108 aa, Artificial Sequence
  Description of Artificial Sequence: Synthetic polypeptide
QDIQMTQSPATLSLSPGERATLSCRASQSVSSYLAWYQQKPGHAPRLLIYGASHRATGIADRFSGSGSGTDFTLTISSLEPEDFAVYYCQQRSNWPITFGQGTRLEIK

SEQ ID NO: 131 - protein, 124 aa, Artificial Sequence; identical to SEQ ID NO: 7
  Description of Artificial Sequence: Synthetic polypeptide

SEQ ID NO: 132 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYDASNRATGIPARFRGSGSGTDFTLTISSLEPEDFAVYYCQQRGNWPITFGQGTRLEIK

SEQ ID NO: 133 - protein, 124 aa, Artificial Sequence; identical to SEQ ID NO: 7
  Description of Artificial Sequence: Synthetic polypeptide

SEQ ID NO: 134 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYDASNRATGIPARFSGSGSGTDFTLTISSLEPADFAVYYCQQRSNWPTTFGQGTRLEIK

SEQ ID NO: 135 - protein, 124 aa, Artificial Sequence; identical to SEQ ID NO: 7
  Description of Artificial Sequence: Synthetic polypeptide

SEQ ID NO: 136 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYDASNRATGIPARFSGSGSGTDFTLTISSLEPEDFAVYYCQQRGNWPITFGQGTRLEIK

SEQ ID NO: 137 - protein, 124 aa, Artificial Sequence; identical to SEQ ID NO: 7
  Description of Artificial Sequence: Synthetic polypeptide

SEQ ID NO: 138 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYGASNRATGIPARFSGSGSGTDFTLTISSLEPEDFVVYFCQQRSNWPITFGQGTRLEIK

SEQ ID NO: 139 - protein, 124 aa, Artificial Sequence; identical to SEQ ID NO: 7
  Description of Artificial Sequence: Synthetic polypeptide

SEQ ID NO: 140 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYGASSRATGIPDRFSGSGSGTDFTLTISSLEPEDFAVYYCQQRSNWPVTFGPGTTVDIK

SEQ ID NO: 141 - protein, 124 aa, Artificial Sequence; identical to SEQ ID NO: 7
  Description of Artificial Sequence: Synthetic polypeptide

SEQ ID NO: 142 - protein, 108 aa, Artificial Sequence
  Description of Artificial Sequence: Synthetic polypeptide
QDIQMTQSPATLSLSPGERATLSCRASQSVSSYLAWYQQKPGQAPRLLIYGASTRATGIPARFSGSGSGTDFTLTISSLEPEDFAVYYCQQRGNWPITFGQGTRLEIK

SEQ ID NO: 143 - protein, 124 aa, Artificial Sequence; identical to SEQ ID NO: 7
  Description of Artificial Sequence: Synthetic polypeptide

SEQ ID NO: 144 - protein, 108 aa, Artificial Sequence
  Description of Artificial Sequence: Synthetic polypeptide
QDIQMTQSPATLSLSPGERATLSCRASQSVSSYLAWYQQKPGQAPRLLVFGASNRATGISDRFSGSGSGTDFTLTISRLEPEDFATYYCQQRGNWPPTFGGGTKVEIR

SEQ ID NO: 145 - protein, 124 aa, Artificial Sequence; identical to SEQ ID NO: 7
  Description of Artificial Sequence: Synthetic polypeptide

SEQ ID NO: 146 - protein, 108 aa, Artificial Sequence
  Description of Artificial Sequence: Synthetic polypeptide
QDIQMTQSPATLSLSPGERATLSCRASQSVSSYLAWYQQRLGQSPRLLIYGASNRATGIPDRFSGSGSGTDFTLTISSLEPEDFAVYYCEQRRSWPLTFGGGTKVEIK

SEQ ID NO: 147 - protein, 124 aa, Artificial Sequence; identical to SEQ ID NO: 7
  Description of Artificial Sequence: Synthetic polypeptide

SEQ ID NO: 148 - protein, 108 aa, Artificial Sequence
  Description of Artificial Sequence: Synthetic polypeptide
QDIQMTQSPATLSLSPGERATLSCRASRSVGTHLAWYQQKPGQPPRLLIYDASVRAAGVPARFSGSGSGTDFTLSISSLESDDFAVYYCQQRGGWPITFGGGTKVEIK

SEQ ID NO: 149 - protein, 124 aa, Artificial Sequence; identical to SEQ ID NO: 7
  Description of Artificial Sequence: Synthetic polypeptide

SEQ ID NO: 150 - protein, 108 aa, Artificial Sequence
  Description of Artificial Sequence: Synthetic polypeptide
QDIQMTQSPATLSLSPGERATLSCRASRSVGTHLAWYQQKPGQPPRLLIYDASVRAAGVPARFSGSGSGTDFTLTISSLEPEDFAVYFCQQRGNWPITFGQGTRLEIK

SEQ ID NO: 151 - protein, 124 aa, Artificial Sequence; identical to SEQ ID NO: 7
  Description of Artificial Sequence: Synthetic polypeptide

SEQ ID NO: 152 - protein, 108 aa, Artificial Sequence
  Description of Artificial Sequence: Synthetic polypeptide
QDIQMTQSPATLSLSPGERATLSCRTSQSVSRYLAWYQQKPGQAPRLLIYGTSNRATGIPARFSGSGSGTDFTLTIDSLEPEDFAIYYCQQRYNWPITFGQGTRLEIK

SEQ ID NO: 153 - protein, 124 aa, Artificial Sequence; identical to SEQ ID NO: 7
  Description of Artificial Sequence: Synthetic polypeptide

SEQ ID NO: 154 - protein, 108 aa, Artificial Sequence
  Description of Artificial Sequence: Synthetic polypeptide
QDIQMTQSPATLSLSPGERATLSCRTSQSVSRYLAWYQQKPGQAPRLLIYGTSNRATGIPARFSGSGSGTDFTLTISSLEPEDFAVYYCQQRYNWPITFGQGTRLEIK

SEQ ID NO: 155 - protein, 124 aa, Artificial Sequence; identical to SEQ ID NO: 7
  Description of Artificial Sequence: Synthetic polypeptide

SEQ ID NO: 156 - protein, 109 aa, Artificial Sequence
  Description of Artificial Sequence: Synthetic polypeptide
QDIQMTQSPATLSLSPGERATLTCRASQSLSRSDLAWYQQRPGQAPRLLIFGASNRATDTPDRFSGSGSGTDFTLTITRLEPEDFAVYYCQQRSNWPPTFGQGTKLEIK

SEQ ID NO: 157 - protein, 124 aa, Artificial Sequence; identical to SEQ ID NO: 7
  Description of Artificial Sequence: Synthetic polypeptide

SEQ ID NO: 158 - protein, 108 aa, Artificial Sequence
  Description of Artificial Sequence: Synthetic polypeptide
QDIQMTQSPATLSLSPGESATLSCRASQSVSSYLAWYQQKPGQAPRLLIYGASNRATGIPARFSGSGSGTDFTLTISSLEPEDFVVYFCQQRSNWPITFGQGTRLEIK

SEQ ID NO: 159 - protein, 124 aa, Artificial Sequence; identical to SEQ ID NO: 7
  Description of Artificial Sequence: Synthetic polypeptide

SEQ ID NO: 160 - protein, 108 aa, Artificial Sequence
  Description of Artificial Sequence: Synthetic polypeptide
QDIQMTQSPATLSLSPGETAILSCRASQSVGRFLAWYQQKPGQAPRLLIYGASSRATGIPDRFSGSGSGTEFTLTISSLQSEDFAVYYCQQRGNWPITFGQGTRLEIK

SEQ ID NO: 161 - protein, 124 aa, Artificial Sequence; identical to SEQ ID NO: 7
  Description of Artificial Sequence: Synthetic polypeptide

SEQ ID NO: 162 - protein, 108 aa, Artificial Sequence
  Description of Artificial Sequence: Synthetic polypeptide
QDIQMTQSPATLSLSPGETATLSCRASQPVGSYLAWYQQKPGQAPRLLIYGASNRATGIPARFSGSGSGTDFTLTISSLEPEDFAVYYCQQRGNWPLTFGGGTKVEIK

SEQ ID NO: 163 - protein, 124 aa, Artificial Sequence; identical to SEQ ID NO: 7
  Description of Artificial Sequence: Synthetic polypeptide

SEQ ID NO: 164 - protein, 108 aa, Artificial Sequence
  Description of Artificial Sequence: Synthetic polypeptide
QDIQMTQSPATLSLSPGETATLSCRASQSVGYYLAWYQQRPGQAPRLLIFGASRRATGIPDRFSGSGSGTDFTLTISRLEPEDFAVYYCQQRSNWPITFGQGTRLEIK

SEQ ID NO: 165 - protein, 124 aa, Artificial Sequence; identical to SEQ ID NO: 7
  Description of Artificial Sequence: Synthetic polypeptide

SEQ ID NO: 166 - protein, 108 aa, Artificial Sequence
  Description of Artificial Sequence: Synthetic polypeptide
QDIQMTQSPATLSVSPGDRATLSCRTSQRVDSNLAWYQQKPGQPPRLLIYGASTRATGVPTRFRGSGSGTDFTLTITSLEPEDFAVYYCQQRRKWPVTFGGGTKVEIK

SEQ ID NO: 167 - protein, 124 aa, Artificial Sequence; identical to SEQ ID NO: 7
  Description of Artificial Sequence: Synthetic polypeptide

SEQ ID NO: 168 - protein, 108 aa, Artificial Sequence
  Description of Artificial Sequence: Synthetic polypeptide
QDIQMTQSPATLSVSPGDTATLSCRASQSVGSDLAWYQQKPGQAPRLLIYGASSRATGIPDRFSGSGSGTDFTLTISRLEPEDFAVYYCQQRGNWPITFGQGTRLEIK

SEQ ID NO: 169 - protein, 124 aa, Artificial Sequence; identical to SEQ ID NO: 7
  Description of Artificial Sequence: Synthetic polypeptide

SEQ ID NO: 170 - protein, 108 aa, Artificial Sequence
  Description of Artificial Sequence: Synthetic polypeptide
QDIQMTQSPATLSVSPGEIATLSCRASQNIGSNLAWYQQKPGQAPRLLIYGASTRAPGIPARFSGSGSGTEFTLTIRSLQSEDFAVYYCQQRRKWPVTFGGGTKVEIK

SEQ ID NO: 171 - protein, 124 aa, Artificial Sequence; identical to SEQ ID NO: 7
  Description of Artificial Sequence: Synthetic polypeptide

SEQ ID NO: 172 - protein, 108 aa, Artificial Sequence
  Description of Artificial Sequence: Synthetic polypeptide
QDIQMTQSPATLSVSPGEKVTLSCRASQNIITNLAWYQQKPGQAPRLLIYGASTRATGIPARFSGSGSGTDFTLTISSLEPEDFAVYYCQQRSNWPITFGPGTKVDIK

SEQ ID NO: 173 - protein, 124 aa, Artificial Sequence; identical to SEQ ID NO: 7
  Description of Artificial Sequence: Synthetic polypeptide

SEQ ID NO: 174 - protein, 108 aa, Artificial Sequence
  Description of Artificial Sequence: Synthetic polypeptide
QDIQMTQSPATLSVSPGERATLSCRASHSVGSDLAWYQQKPGQAPRLLISGASTRTAGIPARFSGSGSGTDFTLTISNLEPEDFAVYYCQQRGNWPPTFGGGTKVEIR

SEQ ID NO: 175 - protein, 124 aa, Artificial Sequence; identical to SEQ ID NO: 7
  Description of Artificial Sequence: Synthetic polypeptide

SEQ ID NO: 176 - protein, 108 aa, Artificial Sequence
  Description of Artificial Sequence: Synthetic polypeptide
QDIQMTQSPATLSVSPGERATLSCRASQGVGSDLAWYLQKPGQAPRLLIYGASSRATGIPDRFSGSGSGTDFTLTISRLEPEDFAVYYCQQRRSWPPTFGQGTKVEIK

SEQ ID NO: 177 - protein, 124 aa, Artificial Sequence; identical to SEQ ID NO: 7
  Description of Artificial Sequence: Synthetic polypeptide

SEQ ID NO: 178 - protein, 108 aa, Artificial Sequence
  Description of Artificial Sequence: Synthetic polypeptide
QDIQMTQSPATLSVSPGERATLSCRASQNVNRDLAWYQQKPGQAPRLLIFGASTRATGIPARFSGSGSGTDFTLTISSLEPEDFAVYFCQQRGNWPITFGQGTRLEIK

SEQ ID NO: 179 - protein, 124 aa, Artificial Sequence; identical to SEQ ID NO: 7
  Description of Artificial Sequence: Synthetic polypeptide

SEQ ID NO: 180 - protein, 108 aa, Artificial Sequence
  Description of Artificial Sequence: Synthetic polypeptide
QDIQMTQSPATLSVSPGERATLSCRASQSINSDLAWYQQKPGQAPRLLIYHTSYRAPGIPARFRGSGSGTDFTLTISSLEPEDFALYFCQQRSDWPVTFGPGTKVDVK

SEQ ID NO: 181 - protein, 124 aa, Artificial Sequence; identical to SEQ ID NO: 7
  Description of Artificial Sequence: Synthetic polypeptide

SEQ ID NO: 182 - protein, 108 aa, Artificial Sequence
  Description of Artificial Sequence: Synthetic polypeptide
QDIQMTQSPATLSVSPGERATLSCRASQSISSDLAWYQQRPGQAPRLLIYGASSRATGVPARFSGSGSGTEFALTISSLEPEDFAVYYCQQRSYWPVTFGGGTRVEIK

SEQ ID NO: 183 - protein, 124 aa, Artificial Sequence; identical to SEQ ID NO: 7
  Description of Artificial Sequence: Synthetic polypeptide

SEQ ID NO: 184 - protein, 108 aa, Artificial Sequence
  Description of Artificial Sequence: Synthetic polypeptide
QDIQMTQSPATLSVSPGERATLSCRASQSISSFLAWYQQKPGQAPRLLIYDASYRATGIPARFSGSGSGTDFTLTISSLEPEDYAVYYCQQRGNWPITFGQGTRLEIK

SEQ ID NO: 185 - protein, 124 aa, Artificial Sequence; identical to SEQ ID NO: 7
  Description of Artificial Sequence: Synthetic polypeptide

SEQ ID NO: 186 - protein, 108 aa, Artificial Sequence
  Description of Artificial Sequence: Synthetic polypeptide
QDIQMTQSPATLSVSPGERATLSCRASQSVGADLAWYQQKPGQAPRLLIYHASTRATGVPARFSGSGSGSEFTLAISSLQSEDFAVYFCQQRGNWPPTFGGGTKVDIK

SEQ ID NO: 187 - protein, 124 aa, Artificial Sequence; identical to SEQ ID NO: 7
  Description of Artificial Sequence: Synthetic polypeptide

SEQ ID NO: 188 - protein, 108 aa, Artificial Sequence
  Description of Artificial Sequence: Synthetic polypeptide
QDIQMTQSPATLSVSPGERATLSCRASQSVGSDLAWYQQKHGQAPRLLMYGASHRATGIPARFSGSGSGTDFTLTISSLEPEDFAVYYCQQRYNWPITFGGGTKVEIK

SEQ ID NO: 189 - protein, 124 aa, Artificial Sequence; identical to SEQ ID NO: 7
  Description of Artificial Sequence: Synthetic polypeptide

SEQ ID NO: 190 - protein, 108 aa, Artificial Sequence
  Description of Artificial Sequence: Synthetic polypeptide
QDIQMTQSPATLSVSPGERATLSCRASQSVGSDLAWYQQKHGQAPRLLMYGASTRATGIPDRFSGSGSGTDFTLTISRLEPEDFAVYYCQQRGNWPPTFGGGTKVEIR

SEQ ID NO: 191 - protein, 124 aa, Artificial Sequence; identical to SEQ ID NO: 7
  Description of Artificial Sequence: Synthetic polypeptide

SEQ ID NO: 192 - protein, 108 aa, Artificial Sequence
  Description of Artificial Sequence: Synthetic polypeptide
QDIQMTQSPATLSVSPGERATLSCRASQSVGSNLAWYQQKPGQAPRLLIYGASIRATGIPARFSGSGSGTDFTLTISSLEPEDFAVYFCQQRGNWPITFGQGTRLEIK

SEQ ID NO: 193 - protein, 124 aa, Artificial Sequence; identical to SEQ ID NO: 7
  Description of Artificial Sequence: Synthetic polypeptide

SEQ ID NO: 194 - protein, 108 aa, Artificial Sequence
  Description of Artificial Sequence: Synthetic polypeptide
QDIQMTQSPATLSVSPGERATLSCRASQSVGSNLAWYQQKPGQAPRLLIYGASTRATGIPARFSGSGSGTEFTLTISSLQSEDFAMYYCQQRAYWPVSFGGGTKVEIK

SEQ ID NO: 195 - protein, 124 aa, Artificial Sequence; identical to SEQ ID NO: 7
  Description of Artificial Sequence: Synthetic polypeptide

SEQ ID NO: 196 - protein, 108 aa, Artificial Sequence
  Description of Artificial Sequence: Synthetic polypeptide
QDIQMTQSPATLSVSPGERATLSCRASQSVGSNLAWYQQKPGQAPRLLIYGASTRATGIPARFSGSGSGTEFTLTISSLQSEDFAVYYCQQRGNWPITFGQGTRLEIK

SEQ ID NO: 197 - protein, 124 aa, Artificial Sequence; identical to SEQ ID NO: 7
  Description of Artificial Sequence: Synthetic polypeptide

SEQ ID NO: 198 - protein, 108 aa, Artificial Sequence
  Description of Artificial Sequence: Synthetic polypeptide
QDIQMTQSPATLSVSPGERATLSCRASQSVGSNLAWYQQKPGQAPRLLIYGASTRATGIPARFSGSGSGTEFTLTVSSLQSEDFAVYYCQQRRNWPVTFGPGTKLDFK

SEQ ID NO: 199 - protein, 124 aa, Artificial Sequence; identical to SEQ ID NO: 7
  Description of Artificial Sequence: Synthetic polypeptide

SEQ ID NO: 200 - protein, 108 aa, Artificial Sequence
  Description of Artificial Sequence: Synthetic polypeptide
QDIQMTQSPATLSVSPGERATLSCRASQSVGSQLAWYQQKPGQAPRLVVYDASTRATGIPARFSGSGSGTDFTLTISSLEPEDYAVYYCQQRGNWPITFGQGTRLEIK

SEQ ID NO: 201 - protein, 124 aa, Artificial Sequence; identical to SEQ ID NO: 7
  Description of Artificial Sequence: Synthetic polypeptide

SEQ ID NO: 202 - protein, 108 aa, Artificial Sequence
  Description of Artificial Sequence: Synthetic polypeptide
QDIQMTQSPATLSVSPGERATLSCRASQSVNSDLAWYQQKPGQAPRLLIYGASTRATGIPARFSGSGSGTDFTLTISSLEPEDYAVYYCQQRGNWPITFGQGTRLEIK

SEQ ID NO: 203 - protein, 124 aa, Artificial Sequence; identical to SEQ ID NO: 7
  Description of Artificial Sequence: Synthetic polypeptide

SEQ ID NO: 204 - protein, 108 aa, Artificial Sequence
  Description of Artificial Sequence: Synthetic polypeptide
QDIQMTQSPATLSVSPGERATLSCRASQSVNTDLAWYQQKPGQAPRLLIYGASTRATGIPARFSGSGSGTEFTLTISSLQSEDFAVYYCQQRRNWPVTFGQGTRLEII

SEQ ID NO: 205 - protein, 124 aa, Artificial Sequence; identical to SEQ ID NO: 7
  Description of Artificial Sequence: Synthetic polypeptide

SEQ ID NO: 206 - protein, 108 aa, Artificial Sequence
  Description of Artificial Sequence: Synthetic polypeptide
QDIQMTQSPATLSVSPGERATLSCRASQSVSSDLAWYQQIPGQAPRLLIYGASTRATGIPVRFSGSGSGTNFTLTISSLEPEDFAVYYCQQRRKWPVTFGGGTKVEIK

SEQ ID NO: 207 - protein, 124 aa, Artificial Sequence; identical to SEQ ID NO: 7
  Description of Artificial Sequence: Synthetic polypeptide

SEQ ID NO: 208 - protein, 108 aa, Artificial Sequence
  Description of Artificial Sequence: Synthetic polypeptide
QDIQMTQSPATLSVSPGERATLSCRASQSVSSDLAWYQQKPGQAPRLLIYAASTRATGIPARFSGSGSGTEFTLTISSLQSEDFAVYYCQQRSNWPVTFGQGTKLEIK

SEQ ID NO: 209 - protein, 124 aa, Artificial Sequence; identical to SEQ ID NO: 7
  Description of Artificial Sequence: Synthetic polypeptide

SEQ ID NO: 210 - protein, 108 aa, Artificial Sequence
  Description of Artificial Sequence: Synthetic polypeptide
QDIQMTQSPATLSVSPGERATLSCRASQSVSSDLAWYQQKPGQAPRLLIYHTSYRAPGIPARFRGSGSGTDFTLTISSLEPEDFALYFCQQRSDWPVTFGPGTKVDVK

SEQ ID NO: 211 - protein, 124 aa, Artificial Sequence; identical to SEQ ID NO: 7
  Description of Artificial Sequence: Synthetic polypeptide

SEQ ID NO: 212 - protein, 108 aa, Artificial Sequence
  Description of Artificial Sequence: Synthetic polypeptide
QDIQMTQSPATLSVSPGERATLSCRASQSVSSDLAWYQQKPGQAPRLLIYRASIRATGIPARFSGSGSGTDFTLTISSLEPEDFAVYFCQQRGFWPITFGQGTRLEIK

SEQ ID NO: 213 - protein, 124 aa, Artificial Sequence; identical to SEQ ID NO: 7
  Description of Artificial Sequence: Synthetic polypeptide

SEQ ID NO: 214 - protein, 110 aa, Artificial Sequence
  Description of Artificial Sequence: Synthetic polypeptide
QDIQMTQSPATLSVSPGERATLSCRASQSVSSDLAWYQQKPGQAPRLLIYRASIRATGIPARFSGSGSGTEFTLTISSLQSEDFAVYYCQQRSAWPVTFGGGSKVDIKRT

SEQ ID NO: 215 - protein, 124 aa, Artificial Sequence; identical to SEQ ID NO: 7
  Description of Artificial Sequence: Synthetic polypeptide

SEQ ID NO: 216 - protein, 108 aa, Artificial Sequence
  Description of Artificial Sequence: Synthetic polypeptide
QDIQMTQSPATLSVSPGERATLSCRASQSVSSDLAWYQQRPGQAPRLLIFGASTRATGIPARFSGSGSGTDFSLTISSLEPEDFAVYYCQQRSNWPPTFGGGTKVEIK

SEQ ID NO: 217 - protein, 124 aa, Artificial Sequence; identical to SEQ ID NO: 7
  Description of Artificial Sequence: Synthetic polypeptide

SEQ ID NO: 218 - protein, 108 aa, Artificial Sequence
  Description of Artificial Sequence: Synthetic polypeptide
QDIQMTQSPATLSVSPGERATLSCRASQSVSSNLAWYQQKPGQAPRLLIYGASTRATGIPARFSGSGSGTEFTLTISSLEPEDFAVYYCQQCYNWPPTFGQGTKVEIK

SEQ ID NO: 219 - protein, 124 aa, Artificial Sequence; identical to SEQ ID NO: 7
  Description of Artificial Sequence: Synthetic polypeptide

SEQ ID NO: 220 - protein, 108 aa, Artificial Sequence
  Description of Artificial Sequence: Synthetic polypeptide
QDIQMTQSPATLSVSPGERATLSCRASQSVSSNLAWYQQKPGQAPRLLIYGASTRATGIPARFSGSGSGTEFTLTISSLQSEDFAVYYCQQRGNWPITFGQGTRLEIK

SEQ ID NO: 221 - protein, 124 aa, Artificial Sequence; identical to SEQ ID NO: 7
  Description of Artificial Sequence: Synthetic polypeptide

SEQ ID NO: 222 - protein, 108 aa, Artificial Sequence
  Description of Artificial Sequence: Synthetic polypeptide
QDIQMTQSPATLSVSPGERATLSCRASQSVSSNLAWYQQKPGQAPRLLIYGASTRATGIPARFSGSGSGTEFTLTISSLQSEDFAVYYCQQRRNWPVTFGQGTRLEII

SEQ ID NO: 223 - protein, 124 aa, Artificial Sequence; identical to SEQ ID NO: 7
  Description of Artificial Sequence: Synthetic polypeptide

SEQ ID NO: 224 - protein, 108 aa, Artificial Sequence
  Description of Artificial Sequence: Synthetic polypeptide
QDIQMTQSPATLSVSPGERATLSCRASQSVSSNLAWYQQKPGQAPRLLIYHASTRATGVPARFSGSGSGSEFTLAISSLEPEDFAVYFCQQRGFWPITFGQGTRLEIK

SEQ ID NO: 225 - protein, 124 aa, Artificial Sequence; identical to SEQ ID NO: 7
  Description of Artificial Sequence: Synthetic polypeptide

SEQ ID NO: 226 - protein, 108 aa, Artificial Sequence
  Description of Artificial Sequence: Synthetic polypeptide
QDIQMTQSPATLSVSPGERATLSCRASQSVSSYLAWYQQRPGQAPRLLIFGASNTATGIPARFSGSGSGTDFTLTISSLEPEDFGVYYCQQRRNWPPTFGQGTKLEIK

SEQ ID NO: 227 - protein, 124 aa, Artificial Sequence; identical to SEQ ID NO: 7
  Description of Artificial Sequence: Synthetic polypeptide

SEQ ID NO: 228 - protein, 108 aa, Artificial Sequence
  Description of Artificial Sequence: Synthetic polypeptide
QDIQMTQSPATLSVSPGERATLSCRASQSVWSNLAWYQQKPGQAPRLLIYDASYRATGIPARFSGSGSGTDFTLTISSLEPEDYAVYYCQQRGNWPITFGQGTRLEIK

SEQ ID NO: 229 - protein, 124 aa, Artificial Sequence; identical to SEQ ID NO: 7
  Description of Artificial Sequence: Synthetic polypeptide

SEQ ID NO: 230 - protein, 108 aa, Artificial Sequence
  Description of Artificial Sequence: Synthetic polypeptide
QDIQMTQSPATLSVSPGERATLSCRASQTVGTFLAWYQHRPGQAPRLLIYGASTRATGIPARFSGSGSGTEFTLTISSLEPEDFAVYYCQQRSNWPPTFGQGTKVEIK

SEQ ID NO: 231 - protein, 124 aa, Artificial Sequence; identical to SEQ ID NO: 7
  Description of Artificial Sequence: Synthetic polypeptide

SEQ ID NO: 232 - protein, 108 aa, Artificial Sequence
  Description of Artificial Sequence: Synthetic polypeptide
QDIQMTQSPATLSVSPGERATVSCRASESVNSDLAWYQQKPGQAPRLLIYGASTRATGIPARFSGSGSGTEFTLTISSMESEDFAVYYCQQRGSWPITFGQGTRLEIK

SEQ ID NO: 233 - protein, 124 aa, Artificial Sequence; identical to SEQ ID NO: 7
  Description of Artificial Sequence: Synthetic polypeptide

SEQ ID NO: 234 - protein, 108 aa, Artificial Sequence
  Description of Artificial Sequence: Synthetic polypeptide
QDIQMTQSPATLSVSPGERVILSCRASQNINSDLAWYKQIPGQAPRLLIYGASTRATGVPARISGSGSGTEFTLTISSLQSEDFAVYYCQQRGGWPITFGGGTKVEIK

SEQ ID NO: 235 - protein, 124 aa, Artificial Sequence; identical to SEQ ID NO: 7
  Description of Artificial Sequence: Synthetic polypeptide

SEQ ID NO: 236 - protein, 108 aa, Artificial Sequence
  Description of Artificial Sequence: Synthetic polypeptide
QDIQMTQSPATLSVSPGERVTLSCKASHSISRNLAWYQQKPGQAPRLLIFGASTRATGIPARFSGSGSGTEFTLTISSLEAEDFAVYYCQQRRNWPVTFGPGTKLDFK

SEQ ID NO: 237 - protein, 124 aa, Artificial Sequence; identical to SEQ ID NO: 7
  Description of Artificial Sequence: Synthetic polypeptide

SEQ ID NO: 238 - protein, 108 aa, Artificial Sequence
  Description of Artificial Sequence: Synthetic polypeptide
QDIQMTQSPATLSVSPGERVTLSCRASQTIFGDLAWFQQKPGQSPRLLIYGASTRATDIPARFSGSGSGTEFTLTISSLEPEDFAVYYCQQRSNWPPTFGGGTKVEIK

SEQ ID NO: 239 - protein, 124 aa, Artificial Sequence; identical to SEQ ID NO: 7
  Description of Artificial Sequence: Synthetic polypeptide

SEQ ID NO: 240 - protein, 108 aa, Artificial Sequence
  Description of Artificial Sequence: Synthetic polypeptide
QDIQMTQSPATLSVSPGERVTLSCRASRSVSNNVAWYQQKPGQAPRLLISEASNRATGVPARFTGSGSGIDFSLSISSLEPEDFAIYYCQQRGGWPITFGGGTKVEIK

SEQ ID NO: 241 - protein, 124 aa, Artificial Sequence; identical to SEQ ID NO: 7
  Description of Artificial Sequence: Synthetic polypeptide

SEQ ID NO: 242 - protein, 108 aa, Artificial Sequence
  Description of Artificial Sequence: Synthetic polypeptide
QDIQMTQSPATVSLSPGERVTLSCRASQSVSNYLAWYQQKPGQAPRLLIYGASNRATGIPARFSGSGSGTDFTLTISSLEPEDFAVYYCQQRRSWPPTFGQGTKVEIK

SEQ ID NO: 243 - protein, 124 aa, Artificial Sequence; identical to SEQ ID NO: 7
  Description of Artificial Sequence: Synthetic polypeptide

SEQ ID NO: 244 - protein, 108 aa, Artificial Sequence
  Description of Artificial Sequence: Synthetic polypeptide
QDIQMTQSPATVSVSPGERATLSCRASQSVGSDLAWYQQKPGQAPRLLIYGASTRATGIPARFSGSGSGTEFTLTITSLQSEDFAVYYCQQRSNWPVTFGGGTKVEIK

SEQ ID NO: 245 - protein, 124 aa, Artificial Sequence; identical to SEQ ID NO: 7
  Description of Artificial Sequence: Synthetic polypeptide

SEQ ID NO: 246 - protein, 108 aa, Artificial Sequence
  Description of Artificial Sequence: Synthetic polypeptide
QDIQMTQSPDILSLSPGERATISCRASQSVNSHVAWYQQKPGQPPRLLIYEASDRAAGVPARFRGSGSGTLFSLTISSLQPEDFVVYYCQQRMYWPPTFGEGTKLERR

SEQ ID NO: 247 - protein, 124 aa, Artificial Sequence; identical to SEQ ID NO: 7
  Description of Artificial Sequence: Synthetic polypeptide

SEQ ID NO: 248 - protein, 109 aa, Artificial Sequence
  Description of Artificial Sequence: Synthetic polypeptide
QDIQMTQSPDTLSLSPGERATLTCRASQSLSRSDLAWYQQRPGQAPRLLIFGASNRATDTPDRFSGSGSGTDFTLTITRLEPEDFAVYYCQQRSNWPPTFGQGTKVEIT

SEQ ID NO: 249 - protein, 124 aa, Artificial Sequence; identical to SEQ ID NO: 7
  Description of Artificial Sequence: Synthetic polypeptide

SEQ ID NO: 250 - protein, 108 aa, Artificial Sequence
  Description of Artificial Sequence: Synthetic polypeptide
QDIQMTQSPDTLSVSPGERATLSCRASQNIGSNLAWYQHKSGQAPRLLIYGATTRATGIPARFSGSGSGTEFTLTISSLQSEDFAVYFCQQRGNWPITFGQGTRLEIK

SEQ ID NO: 251 - protein, 124 aa, Artificial Sequence; identical to SEQ ID NO: 7
  Description of Artificial Sequence: Synthetic polypeptide

SEQ ID NO: 252 - protein, 108 aa, Artificial Sequence
  Description of Artificial Sequence: Synthetic polypeptide
QDIQMTQSPDTVSVSPGEGATLSCRASQGINNNLAWYQQKPGQAPRLLIYDASNRATGIPARFSGSGSGTDFTLTISSLEPEDFAVYFCQQRGNWPITFGQGTRLEIK

SEQ ID NO: 253 - protein, 124 aa, Artificial Sequence; identical to SEQ ID NO: 7
  Description of Artificial Sequence: Synthetic polypeptide

SEQ ID NO: 254 - protein, 108 aa, Artificial Sequence
  Description of Artificial Sequence: Synthetic polypeptide
QDIQMTQSPGTLSFSPGERASLSCRASQSVSSDLAWYQQKPGQAPRLLIYGASNRATGIPVRFSGSGSGTDFTLTISRLEPEDFAVYYCQQRSKWPITFGQGTRLEIK

SEQ ID NO: 255 - protein, 124 aa, Artificial Sequence; identical to SEQ ID NO: 7
  Description of Artificial Sequence: Synthetic polypeptide

SEQ ID NO: 256 - protein, 108 aa, Artificial Sequence
  Description of Artificial Sequence: Synthetic polypeptide
QDIQMTQSPGTLSLSPGDRATLSCRASQSVGSDLAWYQQKPGQAPRLLIYGASNRATGIPVRFSGSGSGTDFTLTISSLEPEDFAVYYCQQRSNWPITFGQGTRLEIK

SEQ ID NO: 257 - protein, 124 aa, Artificial Sequence; identical to SEQ ID NO: 7
  Description of Artificial Sequence: Synthetic polypeptide

SEQ ID NO: 258 - protein, 108 aa, Artificial Sequence
  Description of Artificial Sequence: Synthetic polypeptide
QDIQMTQSPGTLSLSPGDRATLSCRASQSVGSFLAWYQQRPGQAPRLLIYGASNRAPGIPARFSGSGSGTDFTLTISSLEPEDFAVYFCQQRHNWPITFGQGTRLEIK

SEQ ID NO: 259 - protein, 124 aa, Artificial Sequence; identical to SEQ ID NO: 7
  Description of Artificial Sequence: Synthetic polypeptide

SEQ ID NO: 260 - protein, 108 aa, Artificial Sequence
  Description of Artificial Sequence: Synthetic polypeptide
QDIQMTQSPGTLSLSPGEGATLSCRASQSVSNYLAWYQQKPGQAPRLLIYGVSNRATGIPDRFSGSGSGTDFTLTISRLEPEDFAVYYCQQRGNWPPTFGGGTKVEIR

SEQ ID NO: 261 - protein, 124 aa, Artificial Sequence; identical to SEQ ID NO: 7
  Description of Artificial Sequence: Synthetic polypeptide

SEQ ID NO: 262 - protein, 109 aa, Artificial Sequence
  Description of Artificial Sequence: Synthetic polypeptide
QDIQMTQSPGTLSLSPGERATLSCRASQNLGRSDLAWYQQKPGQAPKFLIFGVSNRATGTPDRFSGSGSGTDFTLTISSLEPEDFAVYYCQQRSNWPPTFGGGTKVEIK

SEQ ID NO: 263 - protein, 124 aa, Artificial Sequence; identical to SEQ ID NO: 7
  Description of Artificial Sequence: Synthetic polypeptide

SEQ ID NO: 264 - protein, 108 aa, Artificial Sequence
  Description of Artificial Sequence: Synthetic polypeptide
QDIQMTQSPGTLSLSPGERATLSCRASQNVHTYLAWYQQKPGQAPRLLISEASNRATGVPARFTGSGSGIDFSLSISSLEPEDFAIYYCQQRGGWPITFGGGTKVEIK

SEQ ID NO: 265 - protein, 124 aa, Artificial Sequence; identical to SEQ ID NO: 7
  Description of Artificial Sequence: Synthetic polypeptide

SEQ ID NO: 266 - protein, 108 aa, Artificial Sequence
  Description of Artificial Sequence: Synthetic polypeptide
QDIQMTQSPGTLSLSPGERATLSCRASQSISSFLAWYQQKPGQAPRLLIYDASYRATGIPARFSGSGSGTDFTLTISSLEPEDYAVYYCQQRGNWPITFGQGTRLEIK

SEQ ID NO: 267 - protein, 124 aa, Artificial Sequence; identical to SEQ ID NO: 7
  Description of Artificial Sequence: Synthetic polypeptide

SEQ ID NO: 268 - protein, 109 aa, Artificial Sequence
  Description of Artificial Sequence: Synthetic polypeptide
QDIQMTQSPGTLSLSPGERATLSCRASQSLGRGDLAWYQQNPGQPPRLLIYGASSRATGIPDRFSGSGSGTDFTLTISRLEPEDFAVYYCQQRSNWPPTFGGGTKVEIK

SEQ ID NO: 269 - protein, 124 aa, Artificial Sequence; identical to SEQ ID NO: 7
  Description of Artificial Sequence: Synthetic polypeptide

SEQ ID NO: 270 - protein, 109 aa, Artificial Sequence
  Description of Artificial Sequence: Synthetic polypeptide
QDIQMTQSPGTLSLSPGERATLSCRASQSLGRSDLAWYQQKPGQAPRLLIFGVSNRVTGTPDRFSGSGSGTDFTLTIGSLEPEDFAVYYCQQRSNWPSTFGQGTRLEIK

SEQ ID NO: 271 - protein, 124 aa, Artificial Sequence; identical to SEQ ID NO: 7
  Description of Artificial Sequence: Synthetic polypeptide

SEQ ID NO: 272 - protein, 109 aa, Artificial Sequence
  Description of Artificial Sequence: Synthetic polypeptide
QDIQMTQSPGTLSLSPGERATLSCRASQSLSGNYLAWYQQKPGQAPRLLIYGASSRATGVSDRFSGSGSGTDFTLTISRLEPEDFAVYYCQQRSNWPITFGQGTRLEIK

SEQ ID NO: 273 - protein, 124 aa, Artificial Sequence; identical to SEQ ID NO: 7
  Description of Artificial Sequence: Synthetic polypeptide

SEQ ID NO: 274 - protein, 108 aa, Artificial Sequence
  Description of Artificial Sequence: Synthetic polypeptide
QDIQMTQSPGTLSLSPGERATLSCRASQSVARYLAWYQQKPGQAPRLLIYGASRRGTGIPDRFSGSGSGTDFTLTISSLEPEDFAVYYCQQRRKWPVTFGPGTKVDIK

SEQ ID NO: 275 - protein, 124 aa, Artificial Sequence; identical to SEQ ID NO: 7
  Description of Artificial Sequence: Synthetic polypeptide

SEQ ID NO: 276 - protein, 108 aa, Artificial Sequence
  Description of Artificial Sequence: Synthetic polypeptide
QDIQMTQSPGTLSLSPGERATLSCRASQSVGADLAWYQQKPGQAPRLLIYHASTRATGVPARFSGSGSGSEFTLAISSLQSEDFAVYFCQQRGFWPITFGQGTRLEIK

SEQ ID NO: 277 - protein, 124 aa, Artificial Sequence; identical to SEQ ID NO: 7
  Description of Artificial Sequence: Synthetic polypeptide

SEQ ID NO: 278 - protein, 108 aa, Artificial Sequence
  Description of Artificial Sequence: Synthetic polypeptide
QDIQMTQSPGTLSLSPGERATLSCRASQSVGSDLAWYQQKPGQAPRLLIYGASTRATGIPGRFSGSGSGTEFTLTISSLEPEDFGVYYCQQRRSWPPTFGGGTKVEIK

SEQ ID NO: 279 - protein, 124 aa, Artificial Sequence; identical to SEQ ID NO: 7
  Description of Artificial Sequence: Synthetic polypeptide

SEQ ID NO: 280 - protein, 108 aa, Artificial Sequence
  Description of Artificial Sequence: Synthetic polypeptide
QDIQMTQSPGTLSLSPGERATLSCRASQSVGSDLAWYQQNPGQAPRLLIYGTSTRATGIPARFSGSGSGTDFTLTISSLQSEDFAVYFCQQRGNWPITFGQGTRLEIK

SEQ ID NO: 281 - protein, 124 aa, Artificial Sequence; identical to SEQ ID NO: 7
  Description of Artificial Sequence: Synthetic polypeptide

SEQ ID NO: 282 - protein, 109 aa, Artificial Sequence
  Description of Artificial Sequence: Synthetic polypeptide
QDIQMTQSPGTLSLSPGERATLSCRASQSVGSNFLAWYQQKPGQAPRLLIKGASSRASGIPDRFSGSGSGTDFTLTISRVEPEDFAVYYCQQRSSWPITFGQGTRLDIK

SEQ ID NO: 283 - protein, 124 aa, Artificial Sequence; identical to SEQ ID NO: 7
  Description of Artificial Sequence: Synthetic polypeptide

SEQ ID NO: 284 - protein, 108 aa, Artificial Sequence
  Description of Artificial Sequence: Synthetic polypeptide
QDIQMTQSPGTLSLSPGERATLSCRASQSVNSNLAWYQQKPGQAPRLLIHEASNRATGIPDRFSGSGSERDFTLTISRLEPEDFAMYYCQQRAYWPVSFGGGTKVEIK

SEQ ID NO: 285 - protein, 124 aa, Artificial Sequence; identical to SEQ ID NO: 7
  Description of Artificial Sequence: Synthetic polypeptide

SEQ ID NO: 286 - protein, 108 aa, Artificial Sequence
  Description of Artificial Sequence: Synthetic polypeptide
QDIQMTQSPGTLSLSPGERATLSCRASQSVSRHLAWYQQKPGQAPRLLIYGASNRATGIPARFSGSGSGTDFTLTISSLESEDFAVYYCQQRYNWPITFGQGTRLEIK

SEQ ID NO: 287 - protein, 124 aa, Artificial Sequence; identical to SEQ ID NO: 7
  Description of Artificial Sequence: Synthetic polypeptide

SEQ ID NO: 288 - protein, 108 aa, Artificial Sequence
  Description of Artificial Sequence: Synthetic polypeptide
QDIQMTQSPGTLSLSPGERATLSCRASQSVSSDVAWYQQRPGQAPRLLIYGASARATGVPARFSGSGSGTEFTLTISSLEPEDFAVYYCQQRGNWPITFGQGTRLEIK

SEQ ID NO: 289 - protein, 124 aa, Artificial Sequence; identical to SEQ ID NO: 7
  Description of Artificial Sequence: Synthetic polypeptide

SEQ ID NO: 290 - protein, 108 aa, Artificial Sequence
  Description of Artificial Sequence: Synthetic polypeptide
QDIQMTQSPGTLSLSPGERATLSCRASQSVSSNLAWYQQKPGQAPRLLIYDASYRATGIPARFSGSGSGTDFTLTISSLEPEDYAVYYCQQRGNWPITFGQGTRLEIK

SEQ ID NO: 291 - protein, 124 aa, Artificial Sequence; identical to SEQ ID NO: 7
  Description of Artificial Sequence: Synthetic polypeptide

SEQ ID NO: 292 - protein, 109 aa, Artificial Sequence
  Description of Artificial Sequence: Synthetic polypeptide
QDIQMTQSPGTLSLSPGERATLSCRASQSVSSSHLAWYQQKPGQAPRLLIYGASNRATGIPDRFSGSGSGTDFTLTISSLEPEDFAVYYCQQRRNWPPTFGQGTKLEIK

SEQ ID NO: 293 - protein, 124 aa, Artificial Sequence; identical to SEQ ID NO: 7
  Description of Artificial Sequence: Synthetic polypeptide

SEQ ID NO: 294 - protein, 109 aa, Artificial Sequence
  Description of Artificial Sequence: Synthetic polypeptide
QDIQMTQSPGTLSLSPGERATLSCRASQSVSSSQIAWYQQKPGQAPTILIYGASYRATGIPDRFSGSGSGTDFTLTISSLEPEDFAVYYCQQRSNWPVTFGGGTKVEIK

SEQ ID NO: 295 - protein, 124 aa, Artificial Sequence; identical to SEQ ID NO: 7
  Description of Artificial Sequence: Synthetic polypeptide

SEQ ID NO: 296 - protein, 109 aa, Artificial Sequence
  Description of Artificial Sequence: Synthetic polypeptide
QDIQMTQSPGTLSLSPGERATLSCRASQSVSSSQLAWYQQKPGQAPRLLIYGASNRATAIPARFSGSGSGTDFTLTISSLEPDDSAVYYCQQRSRWPITFGQGTRLEIK

SEQ ID NO: 297 - protein, 124 aa, Artificial Sequence; identical to SEQ ID NO: 7
  Description of Artificial Sequence: Synthetic polypeptide

SEQ ID NO: 298 - protein, 109 aa, Artificial Sequence
  Description of Artificial Sequence: Synthetic polypeptide
QDIQMTQSPGTLSLSPGERATLSCRASQSVSSSQLAWYQQKPGQAPRLLIYGASNRATGIPARFSGSGSGTDFTLTISSLEPEDFAVYYCQQRSNWPVTFGGGTKVEIK

SEQ ID NO: 299 - protein, 124 aa, Artificial Sequence; identical to SEQ ID NO: 7
  Description of Artificial Sequence: Synthetic polypeptide

SEQ ID NO: 300 - protein, 109 aa, Artificial Sequence
  Description of Artificial Sequence: Synthetic polypeptide
QDIQMTQSPGTLSLSPGERATLSCRASQSVSSSQLAWYQQKPGQAPRLLIYGASSRATGIPDRFSGSGSGTDFTLTISRLEPEDFAVYYCQQRGNWPITFGQGTRLEIK

SEQ ID NO: 301 - protein, 124 aa, Artificial Sequence; identical to SEQ ID NO: 7
  Description of Artificial Sequence: Synthetic polypeptide

SEQ ID NO: 302 - protein, 109 aa, Artificial Sequence
  Description of Artificial Sequence: Synthetic polypeptide
QDIQMTQSPGTLSLSPGERATLSCRASQSVSSSQLAWYQQKPGQAPSLLIYGASNRATGIPDRFSGSGSGTDFTLTISSLEPEDFAVYYCQQRSNWPVTFGQGTRLEIK

SEQ ID NO: 303 - protein, 124 aa, Artificial Sequence; identical to SEQ ID NO: 7
  Description of Artificial Sequence: Synthetic polypeptide

SEQ ID NO: 304 - protein, 109 aa, Artificial Sequence
  Description of Artificial Sequence: Synthetic polypeptide
QDIQMTQSPGTLSLSPGERATLSCRASQSVSSSYLAWYQQKPGQAPRLLIYDASSRATGIPDRFSGSGSGTDFTLTISSLEPEDFAVYYCQQRHTWPITFGQGTRLEIK

SEQ ID NO: 305 - protein, 124 aa, Artificial Sequence; identical to SEQ ID NO: 7
  Description of Artificial Sequence: Synthetic polypeptide

SEQ ID NO: 306 - protein, 108 aa, Artificial Sequence
  Description of Artificial Sequence: Synthetic polypeptide
QDIQMTQSPGTLSLSPGERGTLSCRASQSVDNHLAWYQHKPGQAPRLLIYGASTRATGIPARFSGSGSGTDFTLTISSLEPEDFAVYYCQQRRKWPVTFGGGTKVEIK

SEQ ID NO: 307 - protein, 124 aa, Artificial Sequence; identical to SEQ ID NO: 7
  Description of Artificial Sequence: Synthetic polypeptide

SEQ ID NO: 308 - protein, 108 aa, Artificial Sequence
  Description of Artificial Sequence: Synthetic polypeptide
QDIQMTQSPGTLSLSPGETATLSCRASQPVGSYLAWYQQKPGQAPRLLIYGASNRATGIPARFSGSGSGTDFTLAISSLEPEDFAVYYCQQRSNWPITFGQGTRLEIK

SEQ ID NO: 309 - protein, 124 aa, Artificial Sequence; identical to SEQ ID NO: 7
  Description of Artificial Sequence: Synthetic polypeptide

SEQ ID NO: 310 - protein, 109 aa, Artificial Sequence
  Description of Artificial Sequence: Synthetic polypeptide
QDIQMTQSPGTLSLSPGETATLSCRASQSLGRSDLAWYQQLPGQAPRLLIFGVSNRATGIPARFSGSGSGTDFTLTISSLEPEDFAIYYCQQRSNWPVTFGPGTKVDFR

SEQ ID NO: 311 - protein, 124 aa, Artificial Sequence; identical to SEQ ID NO: 7
  Description of Artificial Sequence: Synthetic polypeptide

SEQ ID NO: 312 - protein, 108 aa, Artificial Sequence
  Description of Artificial Sequence: Synthetic polypeptide
QDIQMTQSPGTLSLSPGETATLSCRASQSVSLYLAWYQQKPGQAPRLLIYGASSRATGIPDRFSGSGSGTDFTLTISRLEPEDFAVYYCQQRGSWPITFGQGTRLEIK

SEQ ID NO: 313 - protein, 124 aa, Artificial Sequence; identical to SEQ ID NO: 7
  Description of Artificial Sequence: Synthetic polypeptide

SEQ ID NO: 314 - protein, 108 aa, Artificial Sequence
  Description of Artificial Sequence: Synthetic polypeptide
QDIQMTQSPGTLSVSPGERATLSCRASQDVNRYLAWYQQKPGQPPRLLIYGASTRATGIPARFSGSGSGTDFTLTISSLEPEDFAVYYCQQRSNWPITFGQGTRLEIK

SEQ ID NO: 315 - protein, 124 aa, Artificial Sequence; identical to SEQ ID NO: 7
  Description of Artificial Sequence: Synthetic polypeptide

SEQ ID NO: 316 - protein, 108 aa, Artificial Sequence
  Description of Artificial Sequence: Synthetic polypeptide
QDIQMTQSPGTLSVSPGERATLSCRASQSLNSDLAWYQQKPGQAPRLLIYGASTRATGVPDRFTGSGSGTDFTLTISSLQSEDLAVYYCQQRRNWPITFGQGTRLEIK

SEQ ID NO: 317 - protein, 124 aa, Artificial Sequence; identical to SEQ ID NO: 7
  Description of Artificial Sequence: Synthetic polypeptide

SEQ ID NO: 318 - protein, 108 aa, Artificial Sequence
  Description of Artificial Sequence: Synthetic polypeptide
QDIQMTQSPGTLSVSPGERATLSCRASQSVGSDLAWYQQKPGQAPRLLIYGASTRAIGIPARFSGSGSGTDFTLTISSLEPEDFAVYFCQQRGNWPITFGQGTRLEIK

SEQ ID NO: 319 - protein, 124 aa, Artificial Sequence; identical to SEQ ID NO: 7
  Description of Artificial Sequence: Synthetic polypeptide

SEQ ID NO: 320 - protein, 108 aa, Artificial Sequence
  Description of Artificial Sequence: Synthetic polypeptide
QDIQMTQSPGTLSVSPGERATLSCRASQSVSSNLAWYQQKPGQAPRLLIYGASTRATGIPARFSGSGSGTDFTLTISSLEPEDFAVYFCQQRGFWPITFGQGTRLEIK

SEQ ID NO: 321 - protein, 124 aa, Artificial Sequence; identical to SEQ ID NO: 7
  Description of Artificial Sequence: Synthetic polypeptide

SEQ ID NO: 322 - protein, 108 aa, Artificial Sequence
  Description of Artificial Sequence: Synthetic polypeptide
QDIQMTQSPGTLSVSPGERVTLSCRASQSVSSYLAWYQQKPGQAPRLLIYGASTRVTGIPARFSGSGSGTEFTLTISSLQSEDFAVYYCQQRSSWPITFGQGTRLEIK

SEQ ID NO: 323 - protein, 124 aa, Artificial Sequence; identical to SEQ ID NO: 7
  Description of Artificial Sequence: Synthetic polypeptide

SEQ ID NO: 324 - protein, 109 aa, Artificial Sequence
  Description of Artificial Sequence: Synthetic polypeptide
QDIQMTQSPGTMSLSPGEGATLSCRASQTVSSRLLAWYQKKPAQAPRLLMYAASIRATGIPDRFSGSGSGTDFTLTISRLEPEDFAVYFCQQRRSWPPTFGQGTKVEIK

SEQ ID NO: 325 - protein, 124 aa, Artificial Sequence; identical to SEQ ID NO: 7
  Description of Artificial Sequence: Synthetic polypeptide

SEQ ID NO: 326 - protein, 108 aa, Artificial Sequence
  Description of Artificial Sequence: Synthetic polypeptide
QDIQMTQSPSFLSASLGDRVTITCRATQGIGTFLAWYQQKAGRAPKLLIYGASTLQSGVPSRFSGSGSGTDFTLTISSLEPEDFAVYFCQQRGNWPITFGQGTRLEIK

SEQ ID NO: 327 - protein, 124 aa, Artificial Sequence; identical to SEQ ID NO: 7
  Description of Artificial Sequence: Synthetic polypeptide

SEQ ID NO: 328 - protein, 108 aa, Artificial Sequence
  Description of Artificial Sequence: Synthetic polypeptide
QDIQMTQSPSFLSASLGDRVTITCRATQGIGTFLAWYQQKAGRAPKLLIYGASTLQSGVPSRFSGSGSGTEFTLTISSLQPEDFATYYCQQRGNWPITFGQGTRLEIK

SEQ ID NO: 329 - protein, 124 aa, Artificial Sequence; identical to SEQ ID NO: 7
  Description of Artificial Sequence: Synthetic polypeptide

SEQ ID NO: 330 - protein, 108 aa, Artificial Sequence
  Description of Artificial Sequence: Synthetic polypeptide
QDIQMTQSPSFLSASVGDRVTITCRASQDISSYLAWYQQKPGKAPKLLIYGASTLQSGVPSRFSGSGSGTEFTLTISSLQPEDFAVYYCQQRGNWPITFGQGTRLEIK

SEQ ID NO: 331 - protein, 124 aa, Artificial Sequence; identical to SEQ ID NO: 7
  Description of Artificial Sequence: Synthetic polypeptide

SEQ ID NO: 332 - protein, 108 aa, Artificial Sequence
  Description of Artificial Sequence: Synthetic polypeptide
QDIQMTQSPSFLSASVGDRVTITCRASQGISSYLAWYQQKPGKAPKLLIYAASTLQSGVPSRFSGSGSGTEFTLTISSLQPEDFATYYCQQRSNWPPSFGPGTKVDIK

SEQ ID NO: 333 - protein, 124 aa, Artificial Sequence; identical to SEQ ID NO: 7
  Description of Artificial Sequence: Synthetic polypeptide

SEQ ID NO: 334 - protein, 108 aa, Artificial Sequence
  Description of Artificial Sequence: Synthetic polypeptide
QDIQMTQSPSSLSASVGDRVTITCRASQGIRNDVGWYQQKPGKAPKLLIYAPSNLQSGVPPRFSGSASGTDFTLTISSLQPEDFATYYCLQDFDFPWTFGQGTKVEIK

SEQ ID NO: 335 - protein, 124 aa, Artificial Sequence; identical to SEQ ID NO: 7
  Description of Artificial Sequence: Synthetic polypeptide

SEQ ID NO: 336 - protein, 108 aa, Artificial Sequence
  Description of Artificial Sequence: Synthetic polypeptide
QDIQMTQSPSSLSLSPGERATLSCRASQSISSFLAWYQQKPGQAPRLLIYDASYRATGIPARFSGSGSGTDFTLTISSLEPEDYAVYYCQQRGNWPITFGQGTRLEIK

SEQ ID NO: 337 - protein, 124 aa, Artificial Sequence; identical to SEQ ID NO: 7
  Description of Artificial Sequence: Synthetic polypeptide

SEQ ID NO: 338 - protein, 108 aa, Artificial Sequence
  Description of Artificial Sequence: Synthetic polypeptide
QDIQMTQSPSSLSVSPGERATLSCRASQSVNSDLAWYQQRPGQAPRLLIYAASTRATGVPARFSGTGSGTEFTLTISSLEPEDFAVYYCQQRRKWPVTFGGGTKVEIK

SEQ ID NO: 339 - protein, 124 aa, Artificial Sequence; identical to SEQ ID NO: 7
  Description of Artificial Sequence: Synthetic polypeptide

SEQ ID NO: 340 - protein, 108 aa, Artificial Sequence
  Description of Artificial Sequence: Synthetic polypeptide
QDIQMTQSPSSVSASVGDRVTITCRASQGISTWLAWYQQKPGQAPRLLIYGASNRATGIPDRFSGSGSGTDFTLTISRLEPEDFAVYFCQQRGNWPITFGQGTRLEIK

SEQ ID NO: 341 - protein, 124 aa, Artificial Sequence; identical to SEQ ID NO: 7
  Description of Artificial Sequence: Synthetic polypeptide

SEQ ID NO: 342 - protein, 107 aa, Artificial Sequence
  Description of Artificial Sequence: Synthetic polypeptide
QDIQMTQSPSTLSASVGDRVNITCRASQTISSWLAWYQQKPGKAPKLLIYKASSLQSGVPSRFSGSGSGTDFTLTISSLQPEDFATYYCQQYSSWYTFGQGTKLEIK

SEQ ID NO: 343 - protein, 124 aa, Artificial Sequence; identical to SEQ ID NO: 7
  Description of Artificial Sequence: Synthetic polypeptide

SEQ ID NO: 344 - protein, 108 aa, Artificial Sequence
  Description of Artificial Sequence: Synthetic polypeptide
QDIQMTQSPSTLSLSPGERATLSCRASQNVHTYLAWYQQKPGQAPRLLISEASNRATGVPARFTGSGSGIDFSLSISSLEPEDFAIYYCQQRGGWPITFGGGTKVEIK

SEQ ID NO: 345 - protein, 124 aa, Artificial Sequence; identical to SEQ ID NO: 7
  Description of Artificial Sequence: Synthetic polypeptide

SEQ ID NO: 346 - protein, 108 aa, Artificial Sequence
  Description of Artificial Sequence: Synthetic polypeptide
QDIQMTQSPVTLSVSPGERATLSCRASQNIGSDLAWYQQQPGQAPRLLIYRASFRATGIPARFSGSGSGTDFTLTISSLEPEDFAVYYCQQRGFWPLTFGAGTKVEIK

SEQ ID NO: 347 - protein, 124 aa, Artificial Sequence; identical to SEQ ID NO: 7
  Description of Artificial Sequence: Synthetic polypeptide

SEQ ID NO: 348 - protein, 108 aa, Artificial Sequence; identical to SEQ ID NO: 10
  Description of Artificial Sequence: Synthetic polypeptide

SEQ ID NO: 349 - protein, 124 aa, Artificial Sequence
  Description of Artificial Sequence: Synthetic polypeptide
EVQLLESGGGLVQPGASLRLSCAASGFTFSTYPMWWVRQAPGKGLEWVSYISSSGGGTYYADSVKGRFTISRDNSKNTLYLQMNSLRAEDTAVYYCAKDRAYGDYVGWNGFDYWGQGTLVTVSS

SEQ ID NO: 350 - protein, 108 aa, Artificial Sequence; identical to SEQ ID NO: 10
  Description of Artificial Sequence: Synthetic polypeptide

SEQ ID NO: 351 - protein, 124 aa, Artificial Sequence
  Description of Artificial Sequence: Synthetic polypeptide
EVQLLESGGGLVQPGGSLRLSCAASGFTFSAYDMIWVRQAPGKGLEWVSYIVPSGGFTDYADSVKGRFTISRDNSKNTLYLQMNSLRAEDTAVYYCAKDRAYGDYVGWNGFDYWGQGTLVTVSS

SEQ ID NO: 352 - protein, 108 aa, Artificial Sequence; identical to SEQ ID NO: 10
  Description of Artificial Sequence: Synthetic polypeptide

SEQ ID NO: 353 - protein, 124 aa, Artificial Sequence
  Description of Artificial Sequence: Synthetic polypeptide
EVQLLESGGGLVQPGGSLRLSCAASGFTFSAYDMWWVRQAPGKGLEWVSVIYPSGGTTFYADSVKGRFTISRDNSKNTLYLQMNSLRAEDTAVYYCAKDRAYGDYVGWNGFDYWGQGTLVTVSS

SEQ ID NO: 354 - protein, 108 aa, Artificial Sequence; identical to SEQ ID NO: 10
  Description of Artificial Sequence: Synthetic polypeptide

SEQ ID NO: 355 - protein, 124 aa, Artificial Sequence
  Description of Artificial Sequence: Synthetic polypeptide
EVQLLESGGGLVQPGGSLRLSCAASGFTFSAYDMWWVRQAPGKGLEWVSVIYSSGGMTLYADSVKGRFTISRDNSKNTLYLQMNSLRAEDTAVYYCAKDRAYGDYVGWNGFDYWGQGTLVTVSS

SEQ ID NO: 356 - protein, 108 aa, Artificial Sequence; identical to SEQ ID NO: 10
  Description of Artificial Sequence: Synthetic polypeptide

SEQ ID NO: 357 - protein, 124 aa, Artificial Sequence
  Description of Artificial Sequence: Synthetic polypeptide
EVQLLESGGGLVQPGGSLRLSCAASGFTFSAYDMWWVRQAPGKGLEWVSYISSSGGFTDYADSVKGRFTISRDNSKNTLYLQMNSLRAEDTAVYYCAKDRAYGDYVGWNGFDYWGQGTLVTVSS

SEQ ID NO: 358 - protein, 108 aa, Artificial Sequence; identical to SEQ ID NO: 10
  Description of Artificial Sequence: Synthetic polypeptide

SEQ ID NO: 359 - protein, 124 aa, Artificial Sequence
  Description of Artificial Sequence: Synthetic polypeptide
EVQLLESGGGLVQPGGSLRLSCAASGFTFSAYEMWWVRQAPGKGLEWVSSIYPSGGYTDYADSVKGRFTISRDNSKNTLYLQMNSLRAEDTAVYYCAKDRAYGDYVGWNGFDYWGQGTLVTVSS

SEQ ID NO: 360 - protein, 108 aa, Artificial Sequence; identical to SEQ ID NO: 10
  Description of Artificial Sequence: Synthetic polypeptide

SEQ ID NO: 361 - protein, 124 aa, Artificial Sequence
  Description of Artificial Sequence: Synthetic polypeptide
EVQLLESGGGLVQPGGSLRLSCAASGFTFSAYEMWWVRQAPGKGLEWVSVIYPSGGGTFYADSVKGRFTISRDNSKNTLYLQMNSLRAEDTAVYYCAKDRAYGDYVGWNGFDYWGQGTLVTVSS

SEQ ID NO: 362 - protein, 108 aa, Artificial Sequence; identical to SEQ ID NO: 10
  Description of Artificial Sequence: Synthetic polypeptide

SEQ ID NO: 363 - protein, 124 aa, Artificial Sequence
  Description of Artificial Sequence: Synthetic polypeptide
EVQLLESGGGLVQPGGSLRLSCAASGFTFSAYMMWWVRQAPGKGLEWVSAISPSGGYTGYADSVKGRFTISRDNSKNTLYLQMNSLRAEDTAVYYCAKDRAYGDYVGWNGFDYWGQGTLVTVSS

SEQ ID NO: 364 - protein, 108 aa, Artificial Sequence; identical to SEQ ID NO: 10
  Description of Artificial Sequence: Synthetic polypeptide

SEQ ID NO: 365 - protein, 124 aa, Artificial Sequence
  Description of Artificial Sequence: Synthetic polypeptide
EVQLLESGGGLVQPGGSLRLSCAASGFTFSAYNMIWVRQAPGKGLEWVSYIVPSGGFTGYADSVKGRFTISRDNSKNTLYLQMNSLRAEDTAVYYCAKDRAYGDYVGWNGFDYWGQGTLVTVSS

SEQ ID NO: 366 - protein, 108 aa, Artificial Sequence; identical to SEQ ID NO: 10
  Description of Artificial Sequence: Synthetic polypeptide

SEQ ID NO: 367 - protein, 124 aa, Artificial Sequence
  Description of Artificial Sequence: Synthetic polypeptide
EVQLLESGGGLVQPGGSLRLSCAASGFTFSAYPMIWVRQAPGKGLEWVSYIVPSGGATFYADSVKGRFTISRDNSKNTLYLQMNSLRAEDTAVYYCAKDRAYGDYVGWNGFDYWGQGTLVTVSS

SEQ ID NO: 368 - protein, 108 aa, Artificial Sequence; identical to SEQ ID NO: 10
  Description of Artificial Sequence: Synthetic polypeptide

SEQ ID NO: 369 - protein, 124 aa, Artificial Sequence
  Description of Artificial Sequence: Synthetic polypeptide
EVQLLESGGGLVQPGGSLRLSCAASGFTFSAYPMMWVRQAPGKGLEWVSYIYPSGGGTFYADSVKGRFTISRDNSKNTLYLQMNSLRAEDTAVYYCAKDRAYGDYVGWNGFDYWGQGTLVTVSS

SEQ ID NO: 370 - protein, 108 aa, Artificial Sequence; identical to SEQ ID NO: 10
  Description of Artificial Sequence: Synthetic polypeptide

SEQ ID NO: 371 - protein, 124 aa, Artificial Sequence
  Description of Artificial Sequence: Synthetic polypeptide
EVQLLESGGGLVQPGGSLRLSCAASGFTFSAYPMWWVRQAPGKGLEWVSYIVPSGGMTYYADSVKGRFTISRDNSKNTLYLQMNSLRAEDTAVYYCAKDRAYGDYVGWNGFDYWGQGTLVTVSS

SEQ ID NO: 372 - protein, 108 aa, Artificial Sequence; identical to SEQ ID NO: 10
  Description of Artificial Sequence: Synthetic polypeptide

SEQ ID NO: 373 - protein, 124 aa, Artificial Sequence
  Description of Artificial Sequence: Synthetic polypeptide
EVQLLESGGGLVQPGGSLRLSCAASGFTFSAYPMWWVRQAPGKGLEWVSYIYPSGGATFYADSVKGRFTISRDNSKNTLYLQMNSLRAEDTAVYYCAKDRAYGDYVGWNGFDYWGQGTLVTVSS

SEQ ID NO: 374 - protein, 108 aa, Artificial Sequence; identical to SEQ ID NO: 10
  Description of Artificial Sequence: Synthetic polypeptide

SEQ ID NO: 375 - protein, 124 aa, Artificial Sequence
  Description of Artificial Sequence: Synthetic polypeptide
EVQLLESGGGLVQPGGSLRLSCAASGFTFSDYAMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 376 - protein, 108 aa, Artificial Sequence; identical to SEQ ID NO: 10
  Description of Artificial Sequence: Synthetic polypeptide

SEQ ID NO: 377 - protein, 124 aa, Artificial Sequence
  Description of Artificial Sequence: Synthetic polypeptide
EVQLLESGGGLVQPGGSLRLSCAASGFTFSDYAMWWVRQAPGKGLEWVSWISPSGGGTLYADSVKGRFTISRDNSKNTLYLQMNSLRAEDTAVYYCAKDRAYGDYVGWNGFDYWGQGTLVTVSS

SEQ ID NO: 378 - protein, 108 aa, Artificial Sequence; identical to SEQ ID NO: 10
  Description of Artificial Sequence: Synthetic polypeptide

SEQ ID NO: 379 - protein, 124 aa, Artificial Sequence
  Description of Artificial Sequence: Synthetic polypeptide
EVQLLESGGGLVQPGGSLRLSCAASGFTFSDYDMFWVRQAPGKGLEWVSGIVSSGGYTGYADSVKGRFTISRDNSKNTLYLQMNSLRAEDTAVYYCAKDRAYGDYVGWNGFDYWGQGTLVTVSS

SEQ ID NO: 380 - protein, 108 aa, Artificial Sequence; identical to SEQ ID NO: 10
  Description of Artificial Sequence: Synthetic polypeptide

SEQ ID NO: 381 - protein, 124 aa, Artificial Sequence
  Description of Artificial Sequence: Synthetic polypeptide
EVQLLESGGGLVQPGGSLRLSCAASGFTFSDYDMWWVRQAPGKGLEWVSVISPSGGYTGYADSVKGRFTISRDNSKNTLYLQMNSLRAEDTAVYYCAKDRAYGDYVGWNGFDYWGQGTLVTVSS

SEQ ID NO: 382 - protein, 108 aa, Artificial Sequence; identical to SEQ ID NO: 10
  Description of Artificial Sequence: Synthetic polypeptide

SEQ ID NO: 383 - protein, 124 aa, Artificial Sequence
  Description of Artificial Sequence: Synthetic polypeptide
EVQLLESGGGLVQPGGSLRLSCAASGFTFSDYDMWWVRQAPGKGLEWVSVIYPSGGFTGYADSVKGRFTISRDNSKNTLYLQMNSLRAEDTAVYYCAKDRAYGDYVGWNGFDYWGQGTLVTVSS

SEQ ID NO: 384 - protein, 108 aa, Artificial Sequence; identical to SEQ ID NO: 10
  Description of Artificial Sequence: Synthetic polypeptide

SEQ ID NO: 385 - protein, 123 aa, Artificial Sequence
  Description of Artificial Sequence: Synthetic polypeptide
EVQLLESGGGLVQPGGSLRLSCAASGFTFSDYDMWWVRQAPGKGLEWVSVIYSGGSTYYADSVKGRFTISRDNSKNTLYLQMNSLRAEDTAVYYCAKDRAYGDYVGWNGFDYWGQGTLVTVSS

SEQ ID NO: 386 - protein, 108 aa, Artificial Sequence; identical to SEQ ID NO: 10
  Description of Artificial Sequence: Synthetic polypeptide

SEQ ID NO: 387 - protein, 124 aa, Artificial Sequence
  Description of Artificial Sequence: Synthetic polypeptide
EVQLLESGGGLVQPGGSLRLSCAASGFTFSDYDMWWVRQAPGKGLEWVSVIYSSGGFTSYADSVKGRFTISRDNSKNTLYLQMNSLRAEDTAVYYCAKDRAYGDYVGWNGFDYWGQGTLVTVSS

SEQ ID NO: 388 - protein, 108 aa, Artificial Sequence; identical to SEQ ID NO: 10
  Description of Artificial Sequence: Synthetic polypeptide

SEQ ID NO: 389 - protein, 124 aa, Artificial Sequence
  Description of Artificial Sequence: Synthetic polypeptide
EVQLLESGGGLVQPGGSLRLSCAASGFTFSDYDMWWVRQAPGKGLEWVSVIYSSGGMTYYADSVKGRFTISRDNSKNTLYLQMNSLRAEDTAVYYCAKDRAYGDYVGWNGFDYWGQGTLVTVSS

SEQ ID NO: 390 - protein, 108 aa, Artificial Sequence; identical to SEQ ID NO: 10
  Description of Artificial Sequence: Synthetic polypeptide

SEQ ID NO: 391 - protein, 124 aa, Artificial Sequence
  Description of Artificial Sequence: Synthetic polypeptide
EVQLLESGGGLVQPGGSLRLSCAASGFTFSDYMMWWVRQAPGKGLEWVSSISPSGGFTDYADSVKGRFTISRDNSKNTLYLQMNSLRAEDTAVYYCAKDRAYGDYVGWNGFDYWGQGTLVTVSS

SEQ ID NO: 392 - protein, 108 aa, Artificial Sequence; identical to SEQ ID NO: 10
  Description of Artificial Sequence: Synthetic polypeptide

SEQ ID NO: 393 - protein, 124 aa, Artificial Sequence
  Description of Artificial Sequence: Synthetic polypeptide
EVQLLESGGGLVQPGGSLRLSCAASGFTFSDYNMWWVRQAPGKGLEWVSVIYPSGGWTMYADSVKGRFTISRDNSKNTLYLQMNSLRAEDTAVYYCAKDRAYGDYVGWNGFDYWGQGTLVTVSS

SEQ ID NO: 394 - protein, 108 aa, Artificial Sequence; identical to SEQ ID NO: 10
  Description of Artificial Sequence: Synthetic polypeptide

SEQ ID NO: 395 - protein, 124 aa, Artificial Sequence
  Description of Artificial Sequence: Synthetic polypeptide
EVQLLESGGGLVQPGGSLRLSCAASGFTFSDYPMFWVRQAPGKGLEWVSYIVPSGGWTDYADSVKGRFTISRDNSKNTLYLQMNSLRAEDTAVYYCAKDRAYGDYVGWNGFDYWGQGTLVTVSS

SEQ ID NO: 396 - protein, 108 aa, Artificial Sequence; identical to SEQ ID NO: 10
  Description of Artificial Sequence: Synthetic polypeptide

SEQ ID NO: 397 - protein, 124 aa, Artificial Sequence
  Description of Artificial Sequence: Synthetic polypeptide
EVQLLESGGGLVQPGGSLRLSCAASGFTFSDYPMFWVRQAPGKGLEWVSYIVPSGGWTSYADSVKGRFTISRDNSKNTLYLQMNSLRAEDTAVYYCAKDRAYGDYVGWNGFDYWGQGTLVTVSS

SEQ ID NO: 398 - protein, 108 aa, Artificial Sequence; identical to SEQ ID NO: 10
  Description of Artificial Sequence: Synthetic polypeptide

SEQ ID NO: 399 - protein, 124 aa, Artificial Sequence
  Description of Artificial Sequence: Synthetic polypeptide
EVQLLESGGGLVQPGGSLRLSCAASGFTFSDYPMIWVRQAPGKGLEWVSYISPSGGYTDYADSVKGRFTISRDNSKNTLYLQMNSLRAEDTAVYYCAKDRAYGDYVGWNGFDYWGQGTLVTVSS

SEQ ID NO: 400 - protein, 108 aa, Artificial Sequence; identical to SEQ ID NO: 10
  Description of Artificial Sequence: Synthetic polypeptide

SEQ ID NO: 401 - protein, 124 aa, Artificial Sequence
  Description of Artificial Sequence: Synthetic polypeptide
EVQLLESGGGLVQPGGSLRLSCAASGFTFSDYPMIWVRQAPGKGLEWVSYIVPSGGWTDYADSVKGRFTISRDNSKNTLYLQMNSLRAEDTAVYYCAKDRAYGDYVGWNGFDYWGQGTLVTVSS

SEQ ID NO: 402 - protein, 108 aa, Artificial Sequence; identical to SEQ ID NO: 10
  Description of Artificial Sequence: Synthetic polypeptide

SEQ ID NO: 403 - protein, 124 aa, Artificial Sequence
  Description of Artificial Sequence: Synthetic polypeptide
EVQLLESGGGLVQPGGSLRLSCAASGFTFSDYPMIWVRQAPGKGLEWVSYIYPSGGGTYYADSVKGRFTISRDNSKNTLYLQMNSLRAEDTAVYYCAKDRAYGDYVGWNGFDYWGQGTLVTVSS

SEQ ID NO: 404 - protein, 108 aa, Artificial Sequence; identical to SEQ ID NO: 10
  Description of Artificial Sequence: Synthetic polypeptide

SEQ ID NO: 405 - protein, 124 aa, Artificial Sequence
  Description of Artificial Sequence: Synthetic polypeptide
EVQLLESGGGLVQPGGSLRLSCAASGFTFSDYPMWWVRQAPGKGLEWVSYISSSGGWTSYADSVKGRFTISRDNSKNTLYLQMNSLRAEDTAVYYCAKDRAYGDYVGWNGFDYWGQGTLVTVSS

SEQ ID NO: 406 - protein, 108 aa, Artificial Sequence; identical to SEQ ID NO: 10
  Description of Artificial Sequence: Synthetic polypeptide

SEQ ID NO: 407 - protein, 124 aa, Artificial Sequence
  Description of Artificial Sequence: Synthetic polypeptide
EVQLLESGGGLVQPGGSLRLSCAASGFTFSDYPMWWVRQAPGKGLEWVSYIYPSGGATYYADSVKGRFTISRDNSKNTLYLQMNSLRAEDTAVYYCAKDRAYGDYVGWNGFDYWGQGTLVTVSS

SEQ ID NO: 408 - protein, 108 aa, Artificial Sequence; identical to SEQ ID NO: 10
  Description of Artificial Sequence: Synthetic polypeptide

SEQ ID NO: 409 - protein, 124 aa, Artificial Sequence
  Description of Artificial Sequence: Synthetic polypeptide
EVQLLESGGGLVQPGGSLRLSCAASGFTFSDYQMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 410 - protein, 108 aa, Artificial Sequence; identical to SEQ ID NO: 10
  Description of Artificial Sequence: Synthetic polypeptide

SEQ ID NO: 411 - protein, 124 aa, Artificial Sequence
  Description of Artificial Sequence: Synthetic polypeptide
EVQLLESGGGLVQPGGSLRLSCAASGFTFSEYDMWWVRQAPGKGLEWVSVIYPSGGPTYYADSVKGRFTISRDNSKNTLYLQMNSLRAEDTAVYYCAKDRAYGDYVGWNGFDYWGQGTLVTVSS

SEQ ID NO: 412 - protein, 108 aa, Artificial Sequence; identical to SEQ ID NO: 10
  Description of Artificial Sequence: Synthetic polypeptide

SEQ ID NO: 413 - protein, 124 aa, Artificial Sequence
  Description of Artificial Sequence: Synthetic polypeptide
EVQLLESGGGLVQPGGSLRLSCAASGFTFSEYDMWWVRQAPGKGLEWVSVIYSSGGYTGYADSVKGRFTISRDNSKNTLYLQMNSLRAEDTAVYYCAKDRAYGDYVGWNGFDYWGQGTLVTVSS

SEQ ID NO: 414 - protein, 108 aa, Artificial Sequence; identical to SEQ ID NO: 10
  Description of Artificial Sequence: Synthetic polypeptide

SEQ ID NO: 415 - protein, 124 aa, Artificial Sequence
  Description of Artificial Sequence: Synthetic polypeptide
EVQLLESGGGLVQPGGSLRLSCAASGFTFSEYEMWWVRQAPGKGLEWVSVIYPSGGYTNYADSVKGRFTISRDNSKNTLYLQMNSLRAEDTAVYYCAKDRAYGDYVGWNGFDYWGQGTLVTVSS

SEQ ID NO: 416 - protein, 108 aa, Artificial Sequence; identical to SEQ ID NO: 10
  Description of Artificial Sequence: Synthetic polypeptide

SEQ ID NO: 417 - protein, 124 aa, Artificial Sequence
  Description of Artificial Sequence: Synthetic polypeptide
EVQLLESGGGLVQPGGSLRLSCAASGFTFSEYNMWWVRQAPGKGLEWVSVIYPSGGPTWYADSVKGRFTISRDNSKNTLYLQMNSLRAEDTAVYYCAKDRAYGDYVGWNGFDYWGQGTLVTVSS

SEQ ID NO: 418 - protein, 108 aa, Artificial Sequence; identical to SEQ ID NO: 10
  Description of Artificial Sequence: Synthetic polypeptide

SEQ ID NO: 419 - protein, 124 aa, Artificial Sequence
  Description of Artificial Sequence: Synthetic polypeptide
EVQLLESGGGLVQPGGSLRLSCAASGFTFSEYPMFWVRQAPGKGLEWVSYISPSGGWTSYADSVKGRFTISRDNSKNTLYLQMNSLRAEDTAVYYCAKDRAYGDYVGWNGFDYWGQGTLVTVSS

SEQ ID NO: 420 - protein, 108 aa, Artificial Sequence; identical to SEQ ID NO: 10
  Description of Artificial Sequence: Synthetic polypeptide

SEQ ID NO: 421 - protein, 124 aa, Artificial Sequence
  Description of Artificial Sequence: Synthetic polypeptide
EVQLLESGGGLVQPGGSLRLSCAASGFTFSEYPMIWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 422 - protein, 108 aa, Artificial Sequence; identical to SEQ ID NO: 10
  Description of Artificial Sequence: Synthetic polypeptide

SEQ ID NO: 423 - protein, 124 aa, Artificial Sequence
  Description of Artificial Sequence: Synthetic polypeptide
EVQLLESGGGLVQPGGSLRLSCAASGFTFSEYPMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 424 - protein, 108 aa, Artificial Sequence; identical to SEQ ID NO: 10
  Description of Artificial Sequence: Synthetic polypeptide

SEQ ID NO: 425 - protein, 124 aa, Artificial Sequence
  Description of Artificial Sequence: Synthetic polypeptide
EVQLLESGGGLVQPGGSLRLSCAASGFTFSEYWMWWVRQAPGKGLEWVSSISPSGGGTFYADSVKGRFTISRDNSKNTLYLQMNSLRAEDTAVYYCAKDRAYGDYVGWNGFDYWGQGTLVTVSS

SEQ ID NO: 426 - protein, 108 aa, Artificial Sequence; identical to SEQ ID NO: 10
  Description of Artificial Sequence: Synthetic polypeptide

SEQ ID NO: 427 - protein, 124 aa, Artificial Sequence
  Description of Artificial Sequence: Synthetic polypeptide
EVQLLESGGGLVQPGGSLRLSCAASGFTFSFYDMFWVRQAPGKGLEWVSVISSSGGGTFYADSVKGRFTISRDNSKNTLYLQMNSLRAEDTAVYYCAKDRAYGDYVGWNGFDYWGQGTLVTVSS

SEQ ID NO: 428 - protein, 108 aa, Artificial Sequence; identical to SEQ ID NO: 10
  Description of Artificial Sequence: Synthetic polypeptide

SEQ ID NO: 429 - protein, 124 aa, Artificial Sequence
  Description of Artificial Sequence: Synthetic polypeptide
EVQLLESGGGLVQPGGSLRLSCAASGFTFSFYDMLWVRQAPGKGLEWVSYISSSGGFTGYADSVKGRFTISRDNSKNTLYLQMNSLRAEDTAVYYCAKDRAYGDYVGWNGFDYWGQGTLVTVSS

SEQ ID NO: 430 - protein, 108 aa, Artificial Sequence; identical to SEQ ID NO: 10
  Description of Artificial Sequence: Synthetic polypeptide

SEQ ID NO: 431 - protein, 124 aa, Artificial Sequence
  Description of Artificial Sequence: Synthetic polypeptide
EVQLLESGGGLVQPGGSLRLSCAASGFTFSFYDMWWVRQAPGKGLEWVSSIYSSGGATFYADSVKGRFTISRDNSKNTLYLQMNSLRAEDTAVYYCAKDRAYGDYVGWNGFDYWGQGTLVTVSS

SEQ ID NO: 432 - protein, 108 aa, Artificial Sequence; identical to SEQ ID NO: 10
  Description of Artificial Sequence: Synthetic polypeptide

SEQ ID NO: 433 - protein, 124 aa, Artificial Sequence
  Description of Artificial Sequence: Synthetic polypeptide
EVQLLESGGGLVQPGGSLRLSCAASGFTFSFYDMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 434 - protein, 108 aa, Artificial Sequence; identical to SEQ ID NO: 10
  Description of Artificial Sequence: Synthetic polypeptide

SEQ ID NO: 435 - protein, 124 aa, Artificial Sequence
  Description of Artificial Sequence: Synthetic polypeptide
EVQLLESGGGLVQPGGSLRLSCAASGFTFSFYDMWWVRQAPGKGLEWVSVIYSSGGFTDYADSVKGRFTISRDNSKNTLYLQMNSLRAEDTAVYYCAKDRAYGDYVGWNGFDYWGQGTLVTVSS

SEQ ID NO: 436 - protein, 108 aa, Artificial Sequence; identical to SEQ ID NO: 10
  Description of Artificial Sequence: Synthetic polypeptide

SEQ ID NO: 437 - protein, 124 aa, Artificial Sequence
  Description of Artificial Sequence: Synthetic polypeptide
EVQLLESGGGLVQPGGSLRLSCAASGFTFSFYDMWWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 438 - protein, 108 aa, Artificial Sequence; identical to SEQ ID NO: 10
  Description of Artificial Sequence: Synthetic polypeptide

SEQ ID NO: 439 - protein, 124 aa, Artificial Sequence
  Description of Artificial Sequence: Synthetic polypeptide
EVQLLESGGGLVQPGGSLRLSCAASGFTFSFYDMYWVRQAPGKGLEWVSSIVPSGGATFYADSVKGRFTISRDNSKNTLYLQMNSLRAEDTAVYYCAKDRAYGDYVGWNGFDYWGQGTLVTVSS

SEQ ID NO: 440 - protein, 108 aa, Artificial Sequence; identical to SEQ ID NO: 10
  Description of Artificial Sequence: Synthetic polypeptide

SEQ ID NO: 441 - protein, 124 aa, Artificial Sequence
  Description of Artificial Sequence: Synthetic polypeptide
EVQLLESGGGLVQPGGSLRLSCAASGFTFSFYEMWWVRQAPGKGLEWVSYISPSGGGTYYADSVKGRFTISRDNSKNTLYLQMNSLRAEDTAVYYCAKDRAYGDYVGWNGFDYWGQGTLVTVSS

SEQ ID NO: 442 - protein, 108 aa, Artificial Sequence; identical to SEQ ID NO: 10
  Description of Artificial Sequence: Synthetic polypeptide

SEQ ID NO: 443 - protein, 123 aa, Artificial Sequence
  Description of Artificial Sequence: Synthetic polypeptide
EVQLLESGGGLVQPGGSLRLSCAASGFTFSFYHMIWVRQAPGKGLEWVSYIYSSGGTFYADSVKGRFTISRDNSKNTLYLQMNSLRAEDTAVYYCAKDRAYGDYVGWNGFDYWGQGTLVTVSS

SEQ ID NO: 444 - protein, 108 aa, Artificial Sequence; identical to SEQ ID NO: 10
  Description of Artificial Sequence: Synthetic polypeptide

SEQ ID NO: 445 - protein, 124 aa, Artificial Sequence
  Description of Artificial Sequence: Synthetic polypeptide
EVQLLESGGGLVQPGGSLRLSCAASGFTFSFYMMWWVRQAPGKGLEWVSSISPSGGATFYADSVKGRFTISRDNSKNTLYLQMNSLRAEDTAVYYCAKDRAYGDYVGWNGFDYWGQGTLVTVSS

SEQ ID NO: 446 - protein, 108 aa, Artificial Sequence; identical to SEQ ID NO: 10
  Description of Artificial Sequence: Synthetic polypeptide

SEQ ID NO: 447 - protein, 124 aa, Artificial Sequence
  Description of Artificial Sequence: Synthetic polypeptide
EVQLLESGGGLVQPGGSLRLSCAASGFTFSFYNMWWVRQAPGKGLEWVSSISPSGGGTFYADSVKGRFTISRDNSKNTLYLQMNSLRAEDTAVYYCAKDRAYGDYVGWNGFDYWGQGTLVTVSS

SEQ ID NO: 448 - protein, 108 aa, Artificial Sequence; identical to SEQ ID NO: 10
  Description of Artificial Sequence: Synthetic polypeptide

SEQ ID NO: 449 - protein, 124 aa, Artificial Sequence
  Description of Artificial Sequence: Synthetic polypeptide
EVQLLESGGGLVQPGGSLRLSCAASGFTFSFYNMWWVRQAPGKGLEWVSVIYPSGGKTYYADSVKGRFTISRDNSKNTLYLQMNSLRAEDTAVYYCAKDRAYGDYVGWNGFDYWGQGTLVTVSS

SEQ ID NO: 450 - protein, 108 aa, Artificial Sequence; identical to SEQ ID NO: 10
  Description of Artificial Sequence: Synthetic polypeptide

SEQ ID NO: 451 - protein, 124 aa, Artificial Sequence
  Description of Artificial Sequence: Synthetic polypeptide
EVQLLESGGGLVQPGGSLRLSCAASGFTFSFYNMWWVRQAPGKGLEWVSVIYPSGGPTFYADSVKGRFTISRDNSKNTLYLQMNSLRAEDTAVYYCAKDRAYGDYVGWNGFDYWGQGTLVTVSS

SEQ ID NO: 452 - protein, 108 aa, Artificial Sequence; identical to SEQ ID NO: 10
  Description of Artificial Sequence: Synthetic polypeptide

SEQ ID NO: 453 - protein, 124 aa, Artificial Sequence
  Description of Artificial Sequence: Synthetic polypeptide
EVQLLESGGGLVQPGGSLRLSCAASGFTFSFYPMIWVRQAPGKGLEWVSYISPSGGSTLYADSVKGRFTISRDNSKNTLYLQMNSLRAEDTAVYYCAKDRAYGDYVGWNGFDYWGQGTLVTVSS

SEQ ID NO: 454 - protein, 108 aa, Artificial Sequence; identical to SEQ ID NO: 10
  Description of Artificial Sequence: Synthetic polypeptide

SEQ ID NO: 455 - protein, 124 aa, Artificial Sequence
  Description of Artificial Sequence: Synthetic polypeptide
EVQLLESGGGLVQPGGSLRLSCAASGFTFSFYPMIWVRQAPGKGLEWVSYISSSGGFTDYADSVKGRFTISRDNSKNTLYLQMNSLRAEDTAVYYCAKDRAYGDYVGWNGFDYWGQGTLVTVSS

SEQ ID NO: 456 - protein, 108 aa, Artificial Sequence; identical to SEQ ID NO: 10
  Description of Artificial Sequence: Synthetic polypeptide

SEQ ID NO: 457 - protein, 124 aa, Artificial Sequence
  Description of Artificial Sequence: Synthetic polypeptide
EVQLLESGGGLVQPGGSLRLSCAASGFTFSFYPMIWVRQAPGKGLEWVSYISSSGGYTSYADSVKGRFTISRDNSKNTLYLQMNSLRAEDTAVYYCAKDRAYGDYVGWNGFDYWGQGTLVTVSS

SEQ ID NO: 458 - protein, 108 aa, Artificial Sequence; identical to SEQ ID NO: 10
  Description of Artificial Sequence: Synthetic polypeptide

SEQ ID NO: 459 - protein, 122 aa, Artificial Sequence
  Description of Artificial Sequence: Synthetic polypeptide
EVQLLESGGGLVQPGGSLRLSCAASGFTFSFYPMLWVRQAPGKGLEWVSYISGGYTGYADSVKGRFTISRDNSKNTLYLQMNSLRAEDTAVYYCAKDRAYGDYVGWNGFDYWGQGTLVTVSS

SEQ ID NO: 460 - protein, 108 aa, Artificial Sequence; identical to SEQ ID NO: 10
  Description of Artificial Sequence: Synthetic polypeptide

SEQ ID NO: 461 - protein, 124 aa, Artificial Sequence
  Description of Artificial Sequence: Synthetic polypeptide
EVQLLESGGGLVQPGGSLRLSCAASGFTFSFYPMMWVRQAPGKGLEWVSYISFSGGYTGYADSVKGRFTISRDNSKNTLYLQMNSLRAEDTAVYYCAKDRAYGDYVGWNGFDYWGQGTLVTVSS

SEQ ID NO: 462 - protein, 108 aa, Artificial Sequence; identical to SEQ ID NO: 10
  Description of Artificial Sequence: Synthetic polypeptide

SEQ ID NO: 463 - protein, 124 aa, Artificial Sequence
  Description of Artificial Sequence: Synthetic polypeptide
EVQLLESGGGLVQPGGSLRLSCAASGFTFSFYPMWWVRQAPGKGLEWVSYIYPSGGATFYADSVKGRFTISRDNSKNTLYLQMNSLRAEDTAVYYCAKDRAYGDYVGWNGFDYWGQGTLVTVSS

SEQ ID NO: 464 - protein, 108 aa, Artificial Sequence; identical to SEQ ID NO: 10
  Description of Artificial Sequence: Synthetic polypeptide

SEQ ID NO: 465 - protein, 124 aa, Artificial Sequence
  Description of Artificial Sequence: Synthetic polypeptide
EVQLLESGGGLVQPGGSLRLSCAASGFTFSGYDMWWVRQAPGKGLEWVSVISPSGGGTFYADSVKGRFTISRDNSKNTLYLQMNSLRAEDTAVYYCAKDRAYGDYVGWNGFDYWGQGTLVTVSS

SEQ ID NO: 466 - protein, 108 aa, Artificial Sequence; identical to SEQ ID NO: 10
  Description of Artificial Sequence: Synthetic polypeptide

SEQ ID NO: 467 - protein, 124 aa, Artificial Sequence
  Description of Artificial Sequence: Synthetic polypeptide
EVQLLESGGGLVQPGGSLRLSCAASGFTFSGYDMWWVRQAPGKGLEWVSVIYSSGGTTFYADSVKGRFTISRDNSKNTLYLQMNSLRAEDTAVYYCAKDRAYGDYVGWNGFDYWGQGTLVTVSS

SEQ ID NO: 468 - protein, 108 aa, Artificial Sequence; identical to SEQ ID NO: 10
  Description of Artificial Sequence: Synthetic polypeptide

SEQ ID NO: 469 - protein, 124 aa, Artificial Sequence
  Description of Artificial Sequence: Synthetic polypeptide
EVQLLESGGGLVQPGGSLRLSCAASGFTFSGYNMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 470 - protein, 108 aa, Artificial Sequence; identical to SEQ ID NO: 10
  Description of Artificial Sequence: Synthetic polypeptide

SEQ ID NO: 471 - protein, 124 aa, Artificial Sequence
  Description of Artificial Sequence: Synthetic polypeptide
EVQLLESGGGLVQPGGSLRLSCAASGFTFSGYPMWWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 472 - protein, 108 aa, Artificial Sequence; identical to SEQ ID NO: 10
  Description of Artificial Sequence: Synthetic polypeptide

SEQ ID NO: 473 - protein, 124 aa, Artificial Sequence
  Description of Artificial Sequence: Synthetic polypeptide
EVQLLESGGGLVQPGGSLRLSCAASGFTFSHYAMIWVRQAPGKGLEWVSYIVPSGGWTDYADSVKGRFTISRDNSKNTLYLQMNSLRAEDTAVYYCAKDRAYGDYVGWNGFDYWGQGTLVTVSS

SEQ ID NO: 474 - protein, 108 aa, Artificial Sequence; identical to SEQ ID NO: 10
  Description of Artificial Sequence: Synthetic polypeptide

SEQ ID NO: 475 - protein, 124 aa, Artificial Sequence
  Description of Artificial Sequence: Synthetic polypeptide
EVQLLESGGGLVQPGGSLRLSCAASGFTFSHYAMIWVRQAPGKGLEWVSYIVPSGGWTGYADSVKGRFTISRDNSKNTLYLQMNSLRAEDTAVYYCAKDRAYGDYVGWNGFDYWGQGTLVTVSS

SEQ ID NO: 476 - protein, 108 aa, Artificial Sequence; identical to SEQ ID NO: 10
  Description of Artificial Sequence: Synthetic polypeptide

SEQ ID NO: 477 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSSISPSGGATFYADSVKGRFTISRDNSKNTLYLQMNSLRAEDTAVYYCAKDRAYGDYVGWNGFDYWGQGTLVTVSS

SEQ ID NO: 478 - protein, 108 aa, Artificial Sequence; identical to SEQ ID NO: 10
  Description of Artificial Sequence: Synthetic polypeptide

SEQ ID NO: 479 - protein, 123 aa, Artificial Sequence
  Description of Artificial Sequence: Synthetic polypeptide
EVQLLESGGGLVQPGGSLRLSCAASGFTFSHYDMWWVRQAPGKGLEWVSVIVSSGKTFYADSVKGRFTISRDNSKNTLYLQMNSLRAEDTAVYYCAKDRAYGDYVGWNGFDYWGQGTLVTVSS

SEQ ID NO: 480 - protein, 108 aa, Artificial Sequence; identical to SEQ ID NO: 10
  Description of Artificial Sequence: Synthetic polypeptide

SEQ ID NO: 481 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSVIYPSGGFTDYADSVKGRFTISRDNSKNTLYLQMNSLRAEDTAVYYCAKDRAYGDYVGWNGFDYWGQGTLVTVSS

SEQ ID NO: 482 - protein, 108 aa, Artificial Sequence; identical to SEQ ID NO: 10
  Description of Artificial Sequence: Synthetic polypeptide

SEQ ID NO: 483 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSVIYPSGGHTLYADSVKGRFTISRDNSKNTLYLQMNSLRAEDTAVYYCAKDRAYGDYVGWNGFDYWGQGTLVTVSS

SEQ ID NO: 484 - protein, 108 aa, Artificial Sequence; identical to SEQ ID NO: 10
  Description of Artificial Sequence: Synthetic polypeptide

SEQ ID NO: 485 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSVIYPSGGPTYYADSVKGRFTISRDNSKNTLYLQMNSLRAEDTAVYYCAKDRAYGDYVGWNGFDYWGQGTLVTVSS

SEQ ID NO: 486 - protein, 108 aa, Artificial Sequence; identical to SEQ ID NO: 10
  Description of Artificial Sequence: Synthetic polypeptide

SEQ ID NO: 487 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSVIYPSGGVTYYADSVKGRFTISRDNSKNTLYLQMNSLRAEDTAVYYCAKDRAYGDYVGWNGFDYWGQGTLVTVSS

SEQ ID NO: 488 - protein, 108 aa, Artificial Sequence; identical to SEQ ID NO: 10
  Description of Artificial Sequence: Synthetic polypeptide

SEQ ID NO: 489 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSVIYSSGGFTGYADSVKGRFTISRDNSKNTLYLQMNSLRAEDTAVYYCAKDRAYGDYVGWNGFDYWGQGTLVTVSS

SEQ ID NO: 490 - protein, 108 aa, Artificial Sequence; identical to SEQ ID NO: 10
  Description of Artificial Sequence: Synthetic polypeptide

SEQ ID NO: 491 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSVIYSSGGPTYYADSVKGRFTISRDNSKNTLYLQMNSLRAEDTAVYYCAKDRAYGDYVGWNGFDYWGQGTLVTVSS

SEQ ID NO: 492 - protein, 108 aa, Artificial Sequence; identical to SEQ ID NO: 10
  Description of Artificial Sequence: Synthetic polypeptide

SEQ ID NO: 493 - protein, 124 aa, Artificial Sequence
  Description of Artificial Sequence: Synthetic polypeptide
EVQLLESGGGLVQPGGSLRLSCAASGFTFSHYDMWWVRQAPGKGLEWVSYISPSGGFTSYADSVKGRFTISRDNSKNTLYLQMNSLRAEDTAVYYCAKDRAYGDYVGWNGFDYWGQGTLVTVSS

SEQ ID NO: 494 - protein, 108 aa, Artificial Sequence; identical to SEQ ID NO: 10
  Description of Artificial Sequence: Synthetic polypeptide

SEQ ID NO: 495 - protein, 124 aa, Artificial Sequence
  Description of Artificial Sequence: Synthetic polypeptide
EVQLLESGGGLVQPGGSLRLSCAASGFTFSHYEMWWVRQAPGKGLEWVSSISSSGGGTFYADSVKGRFTISRDNSKNTLYLQMNSLRAEDTAVYYCAKDRAYGDYVGWNGFDYWGQGTLVTVSS

SEQ ID NO: 496 - protein, 108 aa, Artificial Sequence; identical to SEQ ID NO: 10
  Description of Artificial Sequence: Synthetic polypeptide

SEQ ID NO: 497 - protein, 124 aa, Artificial Sequence
  Description of Artificial Sequence: Synthetic polypeptide
EVQLLESGGGLVQPGGSLRLSCAASGFTFSHYEMWWVRQAPGKGLEWVSYIGSSGGSTYYADSVKGRFTISRDNSKNTLYLQMNSLRAEDTAVYYCAKDRAYGDYVGWNGFDYWGQGTLVTVSS

SEQ ID NO: 498 - protein, 108 aa, Artificial Sequence; identical to SEQ ID NO: 10
  Description of Artificial Sequence: Synthetic polypeptide

SEQ ID NO: 499 - protein, 124 aa, Artificial Sequence
  Description of Artificial Sequence: Synthetic polypeptide
EVQLLESGGGLVQPGGSLRLSCAASGFTFSHYMMIWVRQAPGKGLEWVSGISPSGGYTGYADSVKGRFTISRDNSKNTLYLQMNSLRAEDTAVYYCAKDRAYGDYVGWNGFDYWGQGTLVTVSS

SEQ ID NO: 500 - protein, 108 aa, Artificial Sequence; identical to SEQ ID NO: 10
  Description of Artificial Sequence: Synthetic polypeptide

SEQ ID NO: 501 - protein, 124 aa, Artificial Sequence
  Description of Artificial Sequence: Synthetic polypeptide
EVQLLESGGGLVQPGGSLRLSCAASGFTFSHYMMWWVRQAPGKGLEWVSSIYPSGGGTYYADSVKGRFTISRDNSKNTLYLQMNSLRAEDTAVYYCAKDRAYGDYVGWNGFDYWGQGTLVTVSS

SEQ ID NO: 502 - protein, 108 aa, Artificial Sequence; identical to SEQ ID NO: 10
  Description of Artificial Sequence: Synthetic polypeptide

SEQ ID NO: 503 - protein, 123 aa, Artificial Sequence
  Description of Artificial Sequence: Synthetic polypeptide
EVQLLESGGGLVQPGGSLRLSCAASGFTFSHYMMWWVRQAPGKGLEWVSSIYPSGGTYYADSVKGRFTISRDNSKNTLYLQMNSLRAEDTAVYYCAKDRAYGDYVGWNGFDYWGQGTLVTVSS

SEQ ID NO: 504 - protein, 108 aa, Artificial Sequence; identical to SEQ ID NO: 10
  Description of Artificial Sequence: Synthetic polypeptide

SEQ ID NO: 505 - protein, 124 aa, Artificial Sequence
  Description of Artificial Sequence: Synthetic polypeptide
EVQLLESGGGLVQPGGSLRLSCAASGFTFSHYPMFWVRQAPGKGLEWVSYISSSGGWTDYADSVKGRFTISRDNSKNTLYLQMNSLRAEDTAVYYCAKDRAYGDYVGWNGFDYWGQGTLVTVSS

SEQ ID NO: 506 - protein, 108 aa, Artificial Sequence; identical to SEQ ID NO: 10
  Description of Artificial Sequence: Synthetic polypeptide

SEQ ID NO: 507 - protein, 124 aa, Artificial Sequence
  Description of Artificial Sequence: Synthetic polypeptide
EVQLLESGGGLVQPGGSLRLSCAASGFTFSHYPMIWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 508 - protein, 108 aa, Artificial Sequence; identical to SEQ ID NO: 10
  Description of Artificial Sequence: Synthetic polypeptide

SEQ ID NO: 509 - protein, 124 aa, Artificial Sequence
  Description of Artificial Sequence: Synthetic polypeptide
EVQLLESGGGLVQPGGSLRLSCAASGFTFSHYPMIWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 510 - protein, 108 aa, Artificial Sequence; identical to SEQ ID NO: 10
  Description of Artificial Sequence: Synthetic polypeptide

SEQ ID NO: 511 - protein, 124 aa, Artificial Sequence
  Description of Artificial Sequence: Synthetic polypeptide
EVQLLESGGGLVQPGGSLRLSCAASGFTFSHYPMIWVRQAPGKGLEWVSYIYSSGGGTFYADSVKGRFTISRDNSKNTLYLQMNSLRAEDTAVYYCAKDRAYGDYVGWNGFDYWGQGTLVTVSS

SEQ ID NO: 512 - protein, 108 aa, Artificial Sequence; identical to SEQ ID NO: 10
  Description of Artificial Sequence: Synthetic polypeptide

SEQ ID NO: 513 - protein, 124 aa, Artificial Sequence
  Description of Artificial Sequence: Synthetic polypeptide
EVQLLESGGGLVQPGGSLRLSCAASGFTFSHYPMLWVRQAPGKGLEWVSYIYPSGGGTFYADSVKGRFTISRDNSKNTLYLQMNSLRAEDTAVYYCAKDRAYGDYVGWNGFDYWGQGTLVTVSS

SEQ ID NO: 514 - protein, 108 aa, Artificial Sequence; identical to SEQ ID NO: 10
  Description of Artificial Sequence: Synthetic polypeptide

SEQ ID NO: 515 - protein, 124 aa, Artificial Sequence
  Description of Artificial Sequence: Synthetic polypeptide
EVQLLESGGGLVQPGGSLRLSCAASGFTFSHYPMMWVRQAPGKGLEWVSYISSSGGYTGYADSVKGRFTISRDNSKNTLYLQMNSLRAEDTAVYYCAKDRAYGDYVGWNGFDYWGQGTLVTVSS

SEQ ID NO: 516 - protein, 108 aa, Artificial Sequence; identical to SEQ ID NO: 10
  Description of Artificial Sequence: Synthetic polypeptide

SEQ ID NO: 517 - protein, 124 aa, Artificial Sequence
  Description of Artificial Sequence: Synthetic polypeptide
EVQLLESGGGLVQPGGSLRLSCAASGFTFSHYPMMWVRQAPGKGLEWVSYIYSSGGGTYYADSVKGRFTISRDNSKNTLYLQMNSLRAEDTAVYYCAKDRAYGDYVGWNGFDYWGQGTLVTVSS

SEQ ID NO: 518 - protein, 108 aa, Artificial Sequence; identical to SEQ ID NO: 10
  Description of Artificial Sequence: Synthetic polypeptide

SEQ ID NO: 519 - protein, 124 aa, Artificial Sequence
  Description of Artificial Sequence: Synthetic polypeptide
EVQLLESGGGLVQPGGSLRLSCAASGFTFSHYPMVWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 520 - protein, 108 aa, Artificial Sequence; identical to SEQ ID NO: 10
  Description of Artificial Sequence: Synthetic polypeptide

SEQ ID NO: 521 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSSISPSGGATFYADSVKGRFTISRDNSKNTLYLQMNSLRAEDTAVYYCAKDRAYGDYVGWNGFDYWGQGTLVTVSS

SEQ ID NO: 522 - protein, 108 aa, Artificial Sequence; identical to SEQ ID NO: 10
  Description of Artificial Sequence: Synthetic polypeptide

SEQ ID NO: 523 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSVIYSSGGGTFYADSVKGRFTISRDNSKNTLYLQMNSLRAEDTAVYYCAKDRAYGDYVGWNGFDYWGQGTLVTVSS

SEQ ID NO: 524 - protein, 108 aa, Artificial Sequence; identical to SEQ ID NO: 10
  Description of Artificial Sequence: Synthetic polypeptide

SEQ ID NO: 525 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSWIVPSGGFTLYADSVKGRFTISRDNSKNTLYLQMNSLRAEDTAVYYCAKDRAYGDYVGWNGFDYWGQGTLVTVSS

SEQ ID NO: 526 - protein, 108 aa, Artificial Sequence; identical to SEQ ID NO: 10
  Description of Artificial Sequence: Synthetic polypeptide

SEQ ID NO: 527 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSYIHPSGGGTLYADSVKGRFTISRDNSKNTLYLQMNSLRAEDTAVYYCAKDRAYGDYVGWNGFDYWGQGTLVTVSS

SEQ ID NO: 528 - protein, 108 aa, Artificial Sequence; identical to SEQ ID NO: 10
  Description of Artificial Sequence: Synthetic polypeptide

SEQ ID NO: 529 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 530 - protein, 108 aa, Artificial Sequence; identical to SEQ ID NO: 10
  Description of Artificial Sequence: Synthetic polypeptide

SEQ ID NO: 531 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSYIVPSGGATFYADSVKGRFTISRDNSKNTLYLQMNSLRAEDTAVYYCAKDRAYGDYVGWNGFDYWGQGTLVTVSS

SEQ ID NO: 532 - protein, 108 aa, Artificial Sequence; identical to SEQ ID NO: 10
  Description of Artificial Sequence: Synthetic polypeptide

SEQ ID NO: 533 - protein, 124 aa, Artificial Sequence
  Description of Artificial Sequence: Synthetic polypeptide
EVQLLESGGGLVQPGGSLRLSCAASGFTFSHYPMWWVRQAPGKGLEWVSYIYPSGGGTYYADSVKGRFTISRDNSKNTLYLQMNSLRAEDTAVYYCAKDRAYGDYVGWNGFDYWGQGTLVTVSS

SEQ ID NO: 534 - protein, 108 aa, Artificial Sequence; identical to SEQ ID NO: 10
  Description of Artificial Sequence: Synthetic polypeptide

SEQ ID NO: 535 - protein, 124 aa, Artificial Sequence
  Description of Artificial Sequence: Synthetic polypeptide
EVQLLESGGGLVQPGGSLRLSCAASGFTFSHYQMWWVRQAPGKGLEWVSSISSSGGGTYYADSVKGRFTISRDNSKNTLYLQMNSLRAEDTAVYYCAKDRAYGDYVGWNGFDYWGQGTLVTVSS

SEQ ID NO: 536 - protein, 108 aa, Artificial Sequence; identical to SEQ ID NO: 10
  Description of Artificial Sequence: Synthetic polypeptide

SEQ ID NO: 537 - protein, 124 aa, Artificial Sequence
  Description of Artificial Sequence: Synthetic polypeptide
EVQLLESGGGLVQPGGSLRLSCAASGFTFSHYSMMWVRQDPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 538 - protein, 108 aa, Artificial Sequence; identical to SEQ ID NO: 10
  Description of Artificial Sequence: Synthetic polypeptide

SEQ ID NO: 539 - protein, 124 aa, Artificial Sequence
  Description of Artificial Sequence: Synthetic polypeptide
EVQLLESGGGLVQPGGSLRLSCAASGFTFSHYSMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 540 - protein, 108 aa, Artificial Sequence; identical to SEQ ID NO: 10
  Description of Artificial Sequence: Synthetic polypeptide

SEQ ID NO: 541 - protein, 124 aa, Artificial Sequence
  Description of Artificial Sequence: Synthetic polypeptide
EVQLLESGGGLVQPGGSLRLSCAASGFTFSIYDMWWVRQAPGKGLEWVSVISPSGGSTYYADSVKGRFTISRDNSKNTLYLQMNSLRAEDTAVYYCAKDRAYGDYVGWNGFDYWGQGTLVTVSS

SEQ ID NO: 542 - protein, 108 aa, Artificial Sequence; identical to SEQ ID NO: 10
  Description of Artificial Sequence: Synthetic polypeptide

SEQ ID NO: 543 - protein, 124 aa, Artificial Sequence
  Description of Artificial Sequence: Synthetic polypeptide
EVQLLESGGGLVQPGGSLRLSCAASGFTFSIYDMWWVRQAPGKGLEWVSVIYPSGGATWYADSVKGRFTISRDNSKNTLYLQMNSLRAEDTAVYYCAKDRAYGDYVGWNGFDYWGQGTLVTVSS

SEQ ID NO: 544 - protein, 108 aa, Artificial Sequence; identical to SEQ ID NO: 10
  Description of Artificial Sequence: Synthetic polypeptide

SEQ ID NO: 545 - protein, 124 aa, Artificial Sequence
  Description of Artificial Sequence: Synthetic polypeptide
EVQLLESGGGLVQPGGSLRLSCAASGFTFSIYDMWWVRQAPGKGLEWVSVIYPSGGPTFYADSVKGRFTISRDNSKNTLYLQMNSLRAEDTAVYYCAKDRAYGDYVGWNGFDYWGQGTLVTVSS

SEQ ID NO: 546 - protein, 108 aa, Artificial Sequence; identical to SEQ ID NO: 10
  Description of Artificial Sequence: Synthetic polypeptide

SEQ ID NO: 547 - protein, 124 aa, Artificial Sequence
  Description of Artificial Sequence: Synthetic polypeptide
EVQLLESGGGLVQPGGSLRLSCAASGFTFSIYDMWWVRQAPGKGLEWVSVIYPSGGVTFYADSVKGRFTISRDNSKNTLYLQMNSLRAEDTAVYYCAKDRAYGDYVGWNGFDYWGQGTLVTVSS

SEQ ID NO: 548 - protein, 108 aa, Artificial Sequence; identical to SEQ ID NO: 10
  Description of Artificial Sequence: Synthetic polypeptide

SEQ ID NO: 549 - protein, 124 aa, Artificial Sequence
  Description of Artificial Sequence: Synthetic polypeptide
EVQLLESGGGLVQPGGSLRLSCAASGFTFSIYDMWWVRQAPGKGLEWVSVIYSSGGFTGYADSVKGRFTISRDNSKNTLYLQMNSLRAEDTAVYYCAKDRAYGDYVGWNGFDYWGQGTLVTVSS

SEQ ID NO: 550 - protein, 108 aa, Artificial Sequence; identical to SEQ ID NO: 10
  Description of Artificial Sequence: Synthetic polypeptide

SEQ ID NO: 551 - protein, 124 aa, Artificial Sequence
  Description of Artificial Sequence: Synthetic polypeptide
EVQLLESGGGLVQPGGSLRLSCAASGFTFSIYPMIWVRQAPGKGLEWVSYISPSGGYTSYADSVKGRFTISRDNSKNTLYLQMNSLRAEDTAVYYCAKDRAYGDYVGWNGFDYWGQGTLVTVSS

SEQ ID NO: 552 - protein, 108 aa, Artificial Sequence; identical to SEQ ID NO: 10
  Description of Artificial Sequence: Synthetic polypeptide

SEQ ID NO: 553 - protein, 124 aa, Artificial Sequence
  Description of Artificial Sequence: Synthetic polypeptide
EVQLLESGGGLVQPGGSLRLSCAASGFTFSIYPMWWVRQAPGKGLEWVSYISPSGGFTSYADSVKGRFTISRDNSKNTLYLQMNSLRAEDTAVYYCAKDRAYGDYVGWNGFDYWGQGTLVTVSS

SEQ ID NO: 554 - protein, 108 aa, Artificial Sequence; identical to SEQ ID NO: 10
  Description of Artificial Sequence: Synthetic polypeptide

SEQ ID NO: 555 - protein, 124 aa, Artificial Sequence
  Description of Artificial Sequence: Synthetic polypeptide
EVQLLESGGGLVQPGGSLRLSCAASGFTFSIYPMWWVRQAPGKGLEWVSYISPSGGGTYYADSVKGRFTISRDNSKNTLYLQMNSLRAEDTAVYYCAKDRAYGDYVGWNGFDYWGQGTLVTVSS

SEQ ID NO: 556 - protein, 108 aa, Artificial Sequence; identical to SEQ ID NO: 10
  Description of Artificial Sequence: Synthetic polypeptide

SEQ ID NO: 557 - protein, 124 aa, Artificial Sequence
  Description of Artificial Sequence: Synthetic polypeptide
EVQLLESGGGLVQPGGSLRLSCAASGFTFSIYPMWWVRQAPGKGLEWVSYISSSGGWTDYADSVKGRFTISRDNSKNTLYLQMNSLRAEDTAVYYCAKDRAYGDYVGWNGFDYWGQGTLVTVSS

SEQ ID NO: 558 - protein, 108 aa, Artificial Sequence; identical to SEQ ID NO: 10
  Description of Artificial Sequence: Synthetic polypeptide

SEQ ID NO: 559 - protein, 124 aa, Artificial Sequence
  Description of Artificial Sequence: Synthetic polypeptide
EVQLLESGGGLVQPGGSLRLSCAASGFTFSIYPMWWVRQAPGKGLEWVSYIVPSGGMTYYADSVKGRFTISRDNSKNTLYLQMNSLRAEDTAVYYCAKDRAYGDYVGWNGFDYWGQGTLVTVSS

SEQ ID NO: 560 - protein, 108 aa, Artificial Sequence; identical to SEQ ID NO: 10
  Description of Artificial Sequence: Synthetic polypeptide

SEQ ID NO: 561 - protein, 124 aa, Artificial Sequence
  Description of Artificial Sequence: Synthetic polypeptide
EVQLLESGGGLVQPGGSLRLSCAASGFTFSIYPMWWVRQAPGKGLEWVSYIYPSGGGTFYADSVKGRFTISRDNSKNTLYLQMNSLRAEDTAVYYCAKDRAYGDYVGWNGFDYWGQGTLVTVSS

SEQ ID NO: 562 - protein, 108 aa, Artificial Sequence; identical to SEQ ID NO: 10
  Description of Artificial Sequence: Synthetic polypeptide

SEQ ID NO: 563 - protein, 124 aa, Artificial Sequence
  Description of Artificial Sequence: Synthetic polypeptide
EVQLLESGGGLVQPGGSLRLSCAASGFTFSKYAMIWVRQAPGKGLEWVSWIPPSGGYTSYADSVKGRFTISRDNSKNTLYLQMNSLRAEDTAVYYCAKDRAYGDYVGWNGFDYWGQGTLVTVSS

SEQ ID NO: 564 - protein, 108 aa, Artificial Sequence; identical to SEQ ID NO: 10
  Description of Artificial Sequence: Synthetic polypeptide

SEQ ID NO: 565 - protein, 124 aa, Artificial Sequence
  Description of Artificial Sequence: Synthetic polypeptide
EVQLLESGGGLVQPGGSLRLSCAASGFTFSKYAMIWVRQAPGKGLEWVSYISPSGGFTGYADSVKGRFTISRDNSKNTLYLQMNSLRAEDTAVYYCAKDRAYGDYVGWNGFDYWGQGTLVTVSS

SEQ ID NO: 566 - protein, 108 aa, Artificial Sequence; identical to SEQ ID NO: 10
  Description of Artificial Sequence: Synthetic polypeptide

SEQ ID NO: 567 - protein, 124 aa, Artificial Sequence
  Description of Artificial Sequence: Synthetic polypeptide
EVQLLESGGGLVQPGGSLRLSCAASGFTFSKYAMIWVRQSPGKGLEWVSYISSSGGFTDYADSVKGRFTISRDNSKNTLYLQMNSLRAEDTAVYYCAKDRAYGDYVGWNGFDYWGQGTLVTVSS

SEQ ID NO: 568 - protein, 108 aa, Artificial Sequence; identical to SEQ ID NO: 10
  Description of Artificial Sequence: Synthetic polypeptide

SEQ ID NO: 569 - protein, 124 aa, Artificial Sequence
  Description of Artificial Sequence: Synthetic polypeptide
EVQLLESGGGLVQPGGSLRLSCAASGFTFSKYAMWWVRQAPGKGLEWVSSISPSGGGTFYADSVKGRFTISRDNSKNTLYLQMNSLRAEDTAVYYCAKDRAYGDYVGWNGFDYWGQGTLVTVSS

SEQ ID NO: 570 - protein, 108 aa, Artificial Sequence; identical to SEQ ID NO: 10
  Description of Artificial Sequence: Synthetic polypeptide

SEQ ID NO: 571 - protein, 124 aa, Artificial Sequence
  Description of Artificial Sequence: Synthetic polypeptide
EVQLLESGGGLVQPGGSLRLSCAASGFTFSKYAMWWVRQAPGKGLEWVSYIVPSGGRTFYADSVKGRFTISRDNSKNTLYLQMNSLRAEDTAVYYCAKDRAYGDYVGWNGFDYWGQGTLVTVSS

SEQ ID NO: 572 - protein, 108 aa, Artificial Sequence; identical to SEQ ID NO: 10
  Description of Artificial Sequence: Synthetic polypeptide

SEQ ID NO: 573 - protein, 124 aa, Artificial Sequence
  Description of Artificial Sequence: Synthetic polypeptide
EVQLLESGGGLVQPGGSLRLSCAASGFTFSKYDMFWVRQAPGKGLEWVSSIVPSGGATYYADSVKGRFTISRDNSKNTLYLQMNSLRAEDTAVYYCAKDRAYGDYVGWNGFDYWGQGTLVTVSS

SEQ ID NO: 574 - protein, 108 aa, Artificial Sequence; identical to SEQ ID NO: 10
  Description of Artificial Sequence: Synthetic polypeptide

SEQ ID NO: 575 - protein, 124 aa, Artificial Sequence
  Description of Artificial Sequence: Synthetic polypeptide
EVQLLESGGGLVQPGGSLRLSCAASGFTFSKYDMIWVRQAPGKGLEWVSWIGPSGGATMYADSVKGRFTISRDNSKNTLYLQMNSLRAEDTAVYYCAKDRAYGDYVGWNGFDYWGQGTLVTVSS

SEQ ID NO: 576 - protein, 108 aa, Artificial Sequence; identical to SEQ ID NO: 10
  Description of Artificial Sequence: Synthetic polypeptide

SEQ ID NO: 577 - protein, 124 aa, Artificial Sequence
  Description of Artificial Sequence: Synthetic polypeptide
EVQLLESGGGLVQPGGSLRLSCAASGFTFSKYDMIWVRQAPGKGLEWVSYIGSSGGYTGYADSVKGRFTISRDNSKNTLYLQMNSLRAEDTAVYYCAKDRAYGDYVGWNGFDYWGQGTLVTVSS

SEQ ID NO: 578 - protein, 108 aa, Artificial Sequence; identical to SEQ ID NO: 10
  Description of Artificial Sequence: Synthetic polypeptide

SEQ ID NO: 579 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSSISSSGGGTFYADSVKGRFTISRDNSKNTLYLQMNSLRAEDTAVYYCAKDRAYGDYVGWNGFDYWGQGTLVTVSS

SEQ ID NO: 580 - protein, 108 aa, Artificial Sequence; identical to SEQ ID NO: 10
  Description of Artificial Sequence: Synthetic polypeptide

SEQ ID NO: 581 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSVIYPSGGPTFYADSVKGRFTISRDNSKNTLYLQMNSLRAEDTAVYYCAKDRAYGDYVGWNGFDYWGQGTLVTVSS

SEQ ID NO: 582 - protein, 108 aa, Artificial Sequence; identical to SEQ ID NO: 10
  Description of Artificial Sequence: Synthetic polypeptide

SEQ ID NO: 583 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSVIYPSGGQTYYADSVKGRFTISRDNSKNTLYLQMNSLRAEDTAVYYCAKDRAYGDYVGWNGFDYWGQGTLVTVSS

SEQ ID NO: 584 - protein, 108 aa, Artificial Sequence; identical to SEQ ID NO: 10
  Description of Artificial Sequence: Synthetic polypeptide

SEQ ID NO: 585 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSVIYPSGGSTYYADSVKGRFTISRDNSKNTLYLQMNSLRAEDTAVYYCAKDRAYGDYVGWNGFDYWGQGTLVTVSS

SEQ ID NO: 586 - protein, 108 aa, Artificial Sequence; identical to SEQ ID NO: 10
  Description of Artificial Sequence: Synthetic polypeptide

SEQ ID NO: 587 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSVIYSSGGFTLYADSVKGRFTISRDNSKNTLYLQMNSLRAEDTAVYYCAKDRAYGDYVGWNGFDYWGQGTLVTVSS

SEQ ID NO: 588 - protein, 108 aa, Artificial Sequence; identical to SEQ ID NO: 10
  Description of Artificial Sequence: Synthetic polypeptide

SEQ ID NO: 589 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSVIYSSGGFTSYADSVKGRFTISRDNSKNTLYLQMNSLRAEDTAVYYCAKDRAYGDYVGWNGFDYWGQGTLVTVSS

SEQ ID NO: 590 - protein, 108 aa, Artificial Sequence; identical to SEQ ID NO: 10
  Description of Artificial Sequence: Synthetic polypeptide

SEQ ID NO: 591 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSVIYSSGGPTFYADSVKGRFTISRDNSKNTLYLQMNSLRAEDTAVYYCAKDRAYGDYVGWNGFDYWGQGTLVTVSS

SEQ ID NO: 592 - protein, 108 aa, Artificial Sequence; identical to SEQ ID NO: 10
  Description of Artificial Sequence: Synthetic polypeptide

SEQ ID NO: 593 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSYIGPSGGFTDYADSVKGRFTISRDNSKNTLYLQMNSLRAEDTAVYYCAKDRAYGDYVGWNGFDYWGQGTLVTVSS

SEQ ID NO: 594 - protein, 108 aa, Artificial Sequence; identical to SEQ ID NO: 10
  Description of Artificial Sequence: Synthetic polypeptide

SEQ ID NO: 595 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSYISSSGGFTDYADSVKGRFTISRDNSKNTLYLQMNSLRAEDTAVYYCAKDRAYGDYVGWNGFDYWGQGTLVTVSS

SEQ ID NO: 596 - protein, 108 aa, Artificial Sequence; identical to SEQ ID NO: 10
  Description of Artificial Sequence: Synthetic polypeptide

SEQ ID NO: 597 - protein, 124 aa, Artificial Sequence
  Description of Artificial Sequence: Synthetic polypeptide
EVQLLESGGGLVQPGGSLRLSCAASGFTFSKYDMWWVRQAPGKGLEWVSYIVPSGGFIDYADSVKGRFTISRDNSKNTLYLQMNSLRAEDTAVYYCAKDRAYGDYVGWNGFDYWGQGTLVTVSS

SEQ ID NO: 598 - protein, 108 aa, Artificial Sequence; identical to SEQ ID NO: 10
  Description of Artificial Sequence: Synthetic polypeptide

SEQ ID NO: 599 - protein, 124 aa, Artificial Sequence
  Description of Artificial Sequence: Synthetic polypeptide
EVQLLESGGGLVQPGGSLRLSCAASGFTFSKYEMFWVRQAPGKGLEWVSSISSSGGGTFYADSVKGRFTISRDNSKNTLYLQMNSLRAEDTAVYYCAKDRAYGDYVGWNGFDYWGQGTLVTVSS

SEQ ID NO: 600 - protein, 108 aa, Artificial Sequence; identical to SEQ ID NO: 10
  Description of Artificial Sequence: Synthetic polypeptide

SEQ ID NO: 601 - protein, 124 aa, Artificial Sequence
  Description of Artificial Sequence: Synthetic polypeptide
EVQLLESGGGLVQPGGSLRLSCAASGFTFSKYEMWWVRQAPGKGLEWVSVIYPSGGMTYYADSVKGRFTISRDNSKNTLYLQMNSLRAEDTAVYYCAKDRAYGDYVGWNGFDYWGQGTLVTVSS

SEQ ID NO: 602 - protein, 108 aa, Artificial Sequence; identical to SEQ ID NO: 10
  Description of Artificial Sequence: Synthetic polypeptide

SEQ ID NO: 603 - protein, 124 aa, Artificial Sequence
  Description of Artificial Sequence: Synthetic polypeptide
EVQLLESGGGLVQPGGSLRLSCAASGFTFSKYEMWWVRQAPGKGLEWVSVIYPSGGYTGYADSVKGRFTISRDNSKNTLYLQMNSLRAEDTAVYYCAKDRAYGDYVGWNGFDYWGQGTLVTVSS

SEQ ID NO: 604 - protein, 108 aa, Artificial Sequence; identical to SEQ ID NO: 10
  Description of Artificial Sequence: Synthetic polypeptide

SEQ ID NO: 605 - protein, 124 aa, Artificial Sequence
  Description of Artificial Sequence: Synthetic polypeptide
EVQLLESGGGLVQPGGSLRLSCAASGFTFSKYEMWWVRQAPGKGLEWVSVIYSSGGKTYYADSVKGRFTISRDNSKNTLYLQMNSLRAEDTAVYYCAKDRAYGDYVGWNGFDYWGQGTLVTVSS

SEQ ID NO: 606 - protein, 108 aa, Artificial Sequence; identical to SEQ ID NO: 10
  Description of Artificial Sequence: Synthetic polypeptide

SEQ ID NO: 607 - protein, 124 aa, Artificial Sequence
  Description of Artificial Sequence: Synthetic polypeptide
EVQLLESGGGLVQPGGSLRLSCAASGFTFSKYEMWWVRQAPGKGLEWVSYIGPSGGFTDYADSVKGRFTISRDNSKNTLYLQMNSLRAEDTAVYYCAKDRAYGDYVGWNGFDYWGQGTLVTVSS

SEQ ID NO: 608 - protein, 108 aa, Artificial Sequence; identical to SEQ ID NO: 10
  Description of Artificial Sequence: Synthetic polypeptide

SEQ ID NO: 609 - protein, 124 aa, Artificial Sequence
  Description of Artificial Sequence: Synthetic polypeptide
EVQLLESGGGLVQPGGSLRLSCAASGFTFSKYEMWWVRQAPGKGLEWVSYIGPSGGITMYADSVKGRFTISRDNSKNTLYLQMNSLRAEDTAVYYCAKDRAYGDYVGWNGFDYWGQGTLVTVSS

SEQ ID NO: 610 - protein, 108 aa, Artificial Sequence; identical to SEQ ID NO: 10
  Description of Artificial Sequence: Synthetic polypeptide

SEQ ID NO: 611 - protein, 124 aa, Artificial Sequence
  Description of Artificial Sequence: Synthetic polypeptide
EVQLLESGGGLVQPGGSLRLSCAASGFTFSKYEMWWVRQAPGKGLEWVSYISPSGGGTLYADSVKGRFTISRDNSKNTLYLQMNSLRAEDTAVYYCAKDRAYGDYVGWNGFDYWGQGTLVTVSS

SEQ ID NO: 612 - protein, 108 aa, Artificial Sequence; identical to SEQ ID NO: 10
  Description of Artificial Sequence: Synthetic polypeptide

SEQ ID NO: 613 - protein, 124 aa, Artificial Sequence
  Description of Artificial Sequence: Synthetic polypeptide
EVQLLESGGGLVQPGGSLRLSCAASGFTFSKYMMFWVRQAPGKGLEWVSSIYSSGGRTFYADSVKGRFTISRDNSKNTLYLQMNSLRAEDTAVYYCAKDRAYGDYVGWNGFDYWGQGTLVTVSS

SEQ ID NO: 614 - protein, 108 aa, Artificial Sequence; identical to SEQ ID NO: 10
  Description of Artificial Sequence: Synthetic polypeptide

SEQ ID NO: 615 - protein, 124 aa, Artificial Sequence
  Description of Artificial Sequence: Synthetic polypeptide
EVQLLESGGGLVQPGGSLRLSCAASGFTFSKYNMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 616 - protein, 108 aa, Artificial Sequence; identical to SEQ ID NO: 10
  Description of Artificial Sequence: Synthetic polypeptide

SEQ ID NO: 617 - protein, 124 aa, Artificial Sequence
  Description of Artificial Sequence: Synthetic polypeptide
EVQLLESGGGLVQPGGSLRLSCAASGFTFSKYNMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 618 - protein, 108 aa, Artificial Sequence; identical to SEQ ID NO: 10
  Description of Artificial Sequence: Synthetic polypeptide

SEQ ID NO: 619 - protein, 124 aa, Artificial Sequence
  Description of Artificial Sequence: Synthetic polypeptide
EVQLLESGGGLVQPGGSLRLSCAASGFTFSKYPMFWVRQAPGKGLEWVSYIVPSGGYTSYADSVKGRFTISRDNSKNTLYLQMNSLRAEDTAVYYCAKDRAYGDYVGWNGFDYWGQGTLVTVSS

SEQ ID NO: 620 - protein, 108 aa, Artificial Sequence; identical to SEQ ID NO: 10
  Description of Artificial Sequence: Synthetic polypeptide

SEQ ID NO: 621 - protein, 124 aa, Artificial Sequence
  Description of Artificial Sequence: Synthetic polypeptide
EVQLLESGGGLVQPGGSLRLSCAASGFTFSKYPMIWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 622 - protein, 108 aa, Artificial Sequence; identical to SEQ ID NO: 10
  Description of Artificial Sequence: Synthetic polypeptide

SEQ ID NO: 623 - protein, 124 aa, Artificial Sequence
  Description of Artificial Sequence: Synthetic polypeptide
EVQLLESGGGLVQPGGSLRLSCAASGFTFSKYPMIWVRQAPGKGLEWVSYISPSGGYTSYADSVKGRFTISRDNSKNTLYLQMNSLRAEDTAVYYCAKDRAYGDYVGWNGFDYWGQGTLVTVSS

SEQ ID NO: 624 - protein, 108 aa, Artificial Sequence; identical to SEQ ID NO: 10
  Description of Artificial Sequence: Synthetic polypeptide

SEQ ID NO: 625 - protein, 124 aa, Artificial Sequence
  Description of Artificial Sequence: Synthetic polypeptide
EVQLLESGGGLVQPGGSLRLSCAASGFTFSKYPMIWVRQAPGKGLEWVSYISSSGGWTDYADSVKGRFTISRDNSKNTLYLQMNSLRAEDTAVYYCAKDRAYGDYVGWNGFDYWGQGTLVTVSS

SEQ ID NO: 626 - protein, 108 aa, Artificial Sequence; identical to SEQ ID NO: 10
  Description of Artificial Sequence: Synthetic polypeptide

SEQ ID NO: 627 - protein, 124 aa, Artificial Sequence
  Description of Artificial Sequence: Synthetic polypeptide
EVQLLESGGGLVQPGGSLRLSCAASGFTFSKYPMIWVRQAPGKGLEWVSYIYPSGGATYYADSVKGRFTISRDNSKNTLYLQMNSLRAEDTAVYYCAKDRAYGDYVGWNGFDYWGQGTLVTVSS

SEQ ID NO: 628 - protein, 108 aa, Artificial Sequence; identical to SEQ ID NO: 10
  Description of Artificial Sequence: Synthetic polypeptide

SEQ ID NO: 629 - protein, 124 aa, Artificial Sequence
  Description of Artificial Sequence: Synthetic polypeptide
EVQLLESGGGLVQPGGSLRLSCAASGFTFSKYPMIWVRQAPGKGLEWVSYIYPSGGYTSYADSVKGRFTISRDNSKNTLYLQMNSLRAEDTAVYYCAKDRAYGDYVGWNGFDYWGQGTLVTVSS

SEQ ID NO: 630 - protein, 108 aa, Artificial Sequence; identical to SEQ ID NO: 10
  Description of Artificial Sequence: Synthetic polypeptide

SEQ ID NO: 631 - protein, 124 aa, Artificial Sequence
  Description of Artificial Sequence: Synthetic polypeptide
EVQLLESGGGLVQPGGSLRLSCAASGFTFSKYPMIWVRQAPGKGLEWVSYIYSSGGGTYYADSVKGRFTISRDNSKNTLYLQMNSLRAEDTAVYYCAKDRAYGDYVGWNGFDYWGQGTLVTVSS

SEQ ID NO: 632 - protein, 108 aa, Artificial Sequence; identical to SEQ ID NO: 10
  Description of Artificial Sequence: Synthetic polypeptide

SEQ ID NO: 633 - protein, 124 aa, Artificial Sequence
  Description of Artificial Sequence: Synthetic polypeptide
EVQLLESGGGLVQPGGSLRLSCAASGFTFSKYPMMWVRQAPGKGLEWVSYISPSGGFTDYADSVKGRFTISRDNSKNTLYLQMNSLRAEDTAVYYCAKDRAYGDYVGWNGFDYWGQGTLVTVSS

SEQ ID NO: 634 - protein, 108 aa, Artificial Sequence; identical to SEQ ID NO: 10
  Description of Artificial Sequence: Synthetic polypeptide

SEQ ID NO: 635 - protein, 124 aa, Artificial Sequence
  Description of Artificial Sequence: Synthetic polypeptide
EVQLLESGGGLVQPGGSLRLSCAASGFTFSKYPMMWVRQAPGKGLEWVSYIYPSGGYTDYADSVKGRFTISRDNSKNTLYLQMNSLRAEDTAVYYCAKDRAYGDYVGWNGFDYWGQGTLVTVSS

SEQ ID NO: 636 - protein, 108 aa, Artificial Sequence; identical to SEQ ID NO: 10
  Description of Artificial Sequence: Synthetic polypeptide

SEQ ID NO: 637 - protein, 124 aa, Artificial Sequence
  Description of Artificial Sequence: Synthetic polypeptide
EVQLLESGGGLVQPGGSLRLSCAASGFTFSKYPMMWVRQAPGKGLEWVSYIYPSGGYTGYADSVKGRFTISRDNSKNTLYLQMNSLRAEDTAVYYCAKDRAYGDYVGWNGFDYWGQGTLVTVSS

SEQ ID NO: 638 - protein, 108 aa, Artificial Sequence; identical to SEQ ID NO: 10
  Description of Artificial Sequence: Synthetic polypeptide

SEQ ID NO: 639 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSSIVSSGGATYYTDSVKGRFTISRDNSKNTLYLQMNSLRAEDTAVYYCAKDRAYGDYVGWNGFDYWGQGTLVTVSS

SEQ ID NO: 640 - protein, 108 aa, Artificial Sequence; identical to SEQ ID NO: 10
  Description of Artificial Sequence: Synthetic polypeptide

SEQ ID NO: 641 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSSIYPSGGYTGYADSVKGRFTISRDNSKNTLYLQMNSLRAEDTAVYYCAKDRAYGDYVGWNGFDYWGQGTLVTVSS

SEQ ID NO: 642 - protein, 108 aa, Artificial Sequence; identical to SEQ ID NO: 10
  Description of Artificial Sequence: Synthetic polypeptide

SEQ ID NO: 643 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSVISPSGGATYYADSVKGRFTISRDNSKNTLYLQMNSLRAEDTAVYYCAKDRAYGDYVGWNGFDYWGQGTLVTVSS

SEQ ID NO: 644 - protein, 108 aa, Artificial Sequence; identical to SEQ ID NO: 10
  Description of Artificial Sequence: Synthetic polypeptide

SEQ ID NO: 645 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSVIYPSGGYTAYADSVKGRFTISRDNSKNTLYLQMNSLRAEDTAVYYCAKDRAYGDYVGWNGFDYWGQGTLVTVSS

SEQ ID NO: 646 - protein, 108 aa, Artificial Sequence; identical to SEQ ID NO: 10
  Description of Artificial Sequence: Synthetic polypeptide

SEQ ID NO: 647 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSVIYSSGGGTFYADSVKGRFTISRDNSKNTLYLQMNSLRAEDTAVYYCAKDRAYGDYVGWNGFDYWGQGTLVTVSS

SEQ ID NO: 648 - protein, 108 aa, Artificial Sequence; identical to SEQ ID NO: 10
  Description of Artificial Sequence: Synthetic polypeptide

SEQ ID NO: 649 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSYISPSGGGTLYADSVKGRFTISRDNSKNTLYLQMNSLRAEDTAVYYCAKDRAYGDYVGWNGFDYWGQGTLVTVSS

SEQ ID NO: 650 - protein, 108 aa, Artificial Sequence; identical to SEQ ID NO: 10
  Description of Artificial Sequence: Synthetic polypeptide

SEQ ID NO: 651 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSYISPSGGGTYYADSVKGRFTISRDNSKNTLYLQMNSLRAEDTAVYYCAKDRAYGDYVGWNGFDYWGQGTLVTVSS

SEQ ID NO: 652 - protein, 108 aa, Artificial Sequence; identical to SEQ ID NO: 10
  Description of Artificial Sequence: Synthetic polypeptide

SEQ ID NO: 653 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSYISSSGGGTYYADSVKGRFTISRDNSKNTLYLQMNSLRAEDTAVYYCAKDRAYGDYVGWNGFDYWGQGTLVTVSS

SEQ ID NO: 654 - protein, 108 aa, Artificial Sequence; identical to SEQ ID NO: 10
  Description of Artificial Sequence: Synthetic polypeptide

SEQ ID NO: 655 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSYIVPSGGATFYADSVKGRFTISRDNSKNTLYLQMNSLRAEDTAVYYCAKDRAYGDYVGWNGFDYWGQGTLVTVSS

SEQ ID NO: 656 - protein, 108 aa, Artificial Sequence; identical to SEQ ID NO: 10
  Description of Artificial Sequence: Synthetic polypeptide

SEQ ID NO: 657 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSYIVPSGGPTWYADSVKGRFTISRDNSKNTLYLQMNSLRAEDTAVYYCAKDRAYGDYVGWNGFDYWGQGTLVTVSS

SEQ ID NO: 658 - protein, 108 aa, Artificial Sequence; identical to SEQ ID NO: 10
  Description of Artificial Sequence: Synthetic polypeptide

SEQ ID NO: 659 - protein, 124 aa, Artificial Sequence
  Description of Artificial Sequence: Synthetic polypeptide
EVQLLESGGGLVQPGGSLRLSCAASGFTFSKYPMWWVRQAPGKGLEWVSYIVPSGGWTAYADSVKGRFTISRDNSKNTLYLQMNSLRAEDTAVYYCAKDRAYGDYVGWNGFDYWGQGTLVTVSS

SEQ ID NO: 660 - protein, 108 aa, Artificial Sequence; identical to SEQ ID NO: 10
  Description of Artificial Sequence: Synthetic polypeptide

SEQ ID NO: 661 - protein, 124 aa, Artificial Sequence
  Description of Artificial Sequence: Synthetic polypeptide
EVQLLESGGGLVQPGGSLRLSCAASGFTFSKYQMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 662 - protein, 108 aa, Artificial Sequence; identical to SEQ ID NO: 10
  Description of Artificial Sequence: Synthetic polypeptide

SEQ ID NO: 663 - protein, 124 aa, Artificial Sequence
  Description of Artificial Sequence: Synthetic polypeptide
EVQLLESGGGLVQPGGSLRLSCAASGFTFSKYQMWWVRQAPGKGLEWVSSIYPSGGGTFYADSVKGRFTISRDNSKNTLYLQMNSLRAEDTAVYYCAKDRAYGDYVGWNGFDYWGQGTLVTVSS

SEQ ID NO: 664 - protein, 108 aa, Artificial Sequence; identical to SEQ ID NO: 10
  Description of Artificial Sequence: Synthetic polypeptide

SEQ ID NO: 665 - protein, 124 aa, Artificial Sequence
  Description of Artificial Sequence: Synthetic polypeptide
EVQLLESGGGLVQPGGSLRLSCAASGFTFSKYSMIWVRQAPGKGLEWVSYIVPSGGYTGYADSVKGRFTISRDNSKNTLYLQMNSLRAEDTAVYYCAKDRAYGDYVGWNGFDYWGQGTLVTVSS

SEQ ID NO: 666 - protein, 108 aa, Artificial Sequence; identical to SEQ ID NO: 10
  Description of Artificial Sequence: Synthetic polypeptide

SEQ ID NO: 667 - protein, 124 aa, Artificial Sequence
  Description of Artificial Sequence: Synthetic polypeptide
EVQLLESGGGLVQPGGSLRLSCAASGFTFSKYSMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 668 - protein, 108 aa, Artificial Sequence; identical to SEQ ID NO: 10
  Description of Artificial Sequence: Synthetic polypeptide

SEQ ID NO: 669 - protein, 124 aa, Artificial Sequence
  Description of Artificial Sequence: Synthetic polypeptide
EVQLLESGGGLVQPGGSLRLSCAASGFTFSKYSMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 670 - protein, 108 aa, Artificial Sequence; identical to SEQ ID NO: 10
  Description of Artificial Sequence: Synthetic polypeptide

SEQ ID NO: 671 - protein, 124 aa, Artificial Sequence
  Description of Artificial Sequence: Synthetic polypeptide
EVQLLESGGGLVQPGGSLRLSCAASGFTFSKYSMWWVRQAPGKGLEWVSVIYPSGGFTDYADSVKGRFTISRDNSKNTLYLQMNSLRAEDTAVYYCAKDRAYGDYVGWNGFDYWGQGTLVTVSS

SEQ ID NO: 672 - protein, 108 aa, Artificial Sequence; identical to SEQ ID NO: 10
  Description of Artificial Sequence: Synthetic polypeptide

SEQ ID NO: 673 - protein, 124 aa, Artificial Sequence
  Description of Artificial Sequence: Synthetic polypeptide
EVQLLESGGGLVQPGGSLRLSCAASGFTFSKYTMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 674 - protein, 108 aa, Artificial Sequence; identical to SEQ ID NO: 10
  Description of Artificial Sequence: Synthetic polypeptide

SEQ ID NO: 675 - protein, 124 aa, Artificial Sequence
  Description of Artificial Sequence: Synthetic polypeptide
EVQLLESGGGLVQPGGSLRLSCAASGFTFSKYWMWWVRQAPGKGLEWVSVIVPSGGMTYYADSVKGRFTISRDNSKNTLYLQMNSLRAEDTAVYYCAKDRAYGDYVGWNGFDYWGQGTLVTVSS

SEQ ID NO: 676 - protein, 108 aa, Artificial Sequence; identical to SEQ ID NO: 10
  Description of Artificial Sequence: Synthetic polypeptide

SEQ ID NO: 677 - protein, 124 aa, Artificial Sequence
  Description of Artificial Sequence: Synthetic polypeptide
EVQLLESGGGLVQPGGSLRLSCAASGFTFSKYYMWWVRQAPGKGLEWVSSIYSSGGGTFYADSVKGRFTISRDNSKNTLYLQMNSLRAEDTAVYYCAKDRAYGDYVGWNGFDYWGQGTLVTVSS

SEQ ID NO: 678 - protein, 108 aa, Artificial Sequence; identical to SEQ ID NO: 10
  Description of Artificial Sequence: Synthetic polypeptide

SEQ ID NO: 679 - protein, 124 aa, Artificial Sequence
  Description of Artificial Sequence: Synthetic polypeptide
EVQLLESGGGLVQPGGSLRLSCAASGFTFSLYAMIWVRQAPGKGLEWVSYISPSGGFTGYADSVKGRFTISRDNSKNTLYLQMNSLRAEDTAVYYCAKDRAYGDYVGWNGFDYWGQGTLVTVSS

SEQ ID NO: 680 - protein, 108 aa, Artificial Sequence; identical to SEQ ID NO: 10
  Description of Artificial Sequence: Synthetic polypeptide

SEQ ID NO: 681 - protein, 124 aa, Artificial Sequence
  Description of Artificial Sequence: Synthetic polypeptide
EVQLLESGGGLVQPGGSLRLSCAASGFTFSLYAMWWVRQAPGKGLEWVSSIVPSGGKTYYADSVKGRFTISRDNSKNTLYLQMNSLRAEDTAVYYCAKDRAYGDYVGWNGFDYWGQGTLVTVSS

SEQ ID NO: 682 - protein, 108 aa, Artificial Sequence; identical to SEQ ID NO: 10
  Description of Artificial Sequence: Synthetic polypeptide

SEQ ID NO: 683 - protein, 124 aa, Artificial Sequence
  Description of Artificial Sequence: Synthetic polypeptide
EVQLLESGGGLVQPGGSLRLSCAASGFTFSLYAMWWVRQAPGKGLEWVSYIYPSGGGTYYADSVKGRFTISRDNSKNTLYLQMNSLRAEDTAVYYCAKDRAYGDYVGWNGFDYWGQGTLVTVSS

SEQ ID NO: 684 - protein, 108 aa, Artificial Sequence; identical to SEQ ID NO: 10
  Description of Artificial Sequence: Synthetic polypeptide

SEQ ID NO: 685 - protein, 124 aa, Artificial Sequence
  Description of Artificial Sequence: Synthetic polypeptide
EVQLLESGGGLVQPGGSLRLSCAASGFTFSLYDMLWVRQAPGKGLEWVSYIYPSGGFTGYADSVKGRFTISRDNSKNTLYLQMNSLRAEDTAVYYCAKDRAYGDYVGWNGFDYWGQGTLVTVSS

SEQ ID NO: 686 - protein, 108 aa, Artificial Sequence; identical to SEQ ID NO: 10
  Description of Artificial Sequence: Synthetic polypeptide

SEQ ID NO: 687 - protein, 124 aa, Artificial Sequence
  Description of Artificial Sequence: Synthetic polypeptide
EVQLLESGGGLVQPGGSLRLSCAASGFTFSLYDMVWVRQAPGKGLEWVSWIGPSGGLTIYADSVKGRFTISRDNSKNTLYLQMNSLRAEDTAVYYCAKDRAYGDYVGWNGFDYWGQGTLVTVSS

SEQ ID NO: 688 - protein, 108 aa, Artificial Sequence; identical to SEQ ID NO: 10
  Description of Artificial Sequence: Synthetic polypeptide

SEQ ID NO: 689 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSSISSSGGYTGYADSVKGRFTISRDNSKNTLYLQMNSLRAEDTAVYYCAKDRAYGDYVGWNGFDYWGQGTLVTVSS

SEQ ID NO: 690 - protein, 108 aa, Artificial Sequence; identical to SEQ ID NO: 10
  Description of Artificial Sequence: Synthetic polypeptide

SEQ ID NO: 691 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSVIRPSGGSTYYADSVKGRFTISRDNSKNTLYLQMNSLRAEDTAVYYCAKDRAYGDYVGWNGFDYWGQGTLVTVSS

SEQ ID NO: 692 - protein, 108 aa, Artificial Sequence; identical to SEQ ID NO: 10
  Description of Artificial Sequence: Synthetic polypeptide

SEQ ID NO: 693 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSVIYPSGGPTYYADSVKGRFTISRDNSKNTLYLQMNSLRAEDTAVYYCAKDRAYGDYVGWNGFDYWGQGTLVTVSS

SEQ ID NO: 694 - protein, 108 aa, Artificial Sequence; identical to SEQ ID NO: 10
  Description of Artificial Sequence: Synthetic polypeptide

SEQ ID NO: 695 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 696 - protein, 108 aa, Artificial Sequence; identical to SEQ ID NO: 10
  Description of Artificial Sequence: Synthetic polypeptide

SEQ ID NO: 697 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSVIYSSGGTTFYADSVKGRFTISRDNSKNTLYLQMNSLRAEDTAVYYCAKDRAYGDYVGWNGFDYWGQGTLVTVSS

SEQ ID NO: 698 - protein, 108 aa, Artificial Sequence; identical to SEQ ID NO: 10
  Description of Artificial Sequence: Synthetic polypeptide

SEQ ID NO: 699 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSVIYSSGGYTAYADSVKGRFTISRDNSKNTLYLQMNSLRAEDTAVYYCAKDRAYGDYVGWNGFDYWGQGTLVTVSS

SEQ ID NO: 700 - protein, 108 aa, Artificial Sequence; identical to SEQ ID NO: 10
  Description of Artificial Sequence: Synthetic polypeptide

SEQ ID NO: 701 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSVIYSSGGYTGYADSVKGRFTISRDNSKNTLYLQMNSLRAEDTAVYYCAKDRAYGDYVGWNGFDYWGQGTLVTVSS

SEQ ID NO: 702 - protein, 108 aa, Artificial Sequence; identical to SEQ ID NO: 10
  Description of Artificial Sequence: Synthetic polypeptide

SEQ ID NO: 703 - protein, 124 aa, Artificial Sequence
  Description of Artificial Sequence: Synthetic polypeptide
EVQLLESGGGLVQPGGSLRLSCAASGFTFSLYDMWWVRQAPGKGLEWVSYIGPSGGNTLYADSVKGRFTISRDNSKNTLYLQMNSLRAEDTAVYYCAKDRAYGDYVGWNGFDYWGQGTLVTVSS

SEQ ID NO: 704 - protein, 108 aa, Artificial Sequence; identical to SEQ ID NO: 10
  Description of Artificial Sequence: Synthetic polypeptide

SEQ ID NO: 705 - protein, 124 aa, Artificial Sequence
  Description of Artificial Sequence: Synthetic polypeptide
EVQLLESGGGLVQPGGSLRLSCAASGFTFSLYEMWWVRQAPGKGLEWVSVISPSGGGTYYADSVKGRFTISRDNSKNTLYLQMNSLRAEDTAVYYCAKDRAYGDYVGWNGFDYWGQGTLVTVSS

SEQ ID NO: 706 - protein, 108 aa, Artificial Sequence; identical to SEQ ID NO: 10
  Description of Artificial Sequence: Synthetic polypeptide

SEQ ID NO: 707 - protein, 124 aa, Artificial Sequence
  Description of Artificial Sequence: Synthetic polypeptide
EVQLLESGGGLVQPGGSLRLSCAASGFTFSLYEMWWVRQAPGKGLEWVSYISSSGGGTLYADSVKGRFTISRDNSKNTLYLQMNSLRAEDTAVYYCAKDRAYGDYVGWNGFDYWGQGTLVTVSS

SEQ ID NO: 708 - protein, 108 aa, Artificial Sequence; identical to SEQ ID NO: 10
  Description of Artificial Sequence: Synthetic polypeptide

SEQ ID NO: 709 - protein, 123 aa, Artificial Sequence
  Description of Artificial Sequence: Synthetic polypeptide
EVQLLESGGGLVQPGGSLRLSCAASGFTFSLYMMWWVRKAPGKGLEWVSSIYPSGGTYYADSVKGRFTISRDNSKNTLYLQMNSLRAEDTAVYYCAKDRAYGDYVGWNGFDYWGQGTLVTVSS

SEQ ID NO: 710 - protein, 108 aa, Artificial Sequence; identical to SEQ ID NO: 10
  Description of Artificial Sequence: Synthetic polypeptide

SEQ ID NO: 711 - protein, 124 aa, Artificial Sequence
  Description of Artificial Sequence: Synthetic polypeptide
EVQLLESGGGLVQPGGSLRLSCAASGFTFSLYNMWWVRQAPGKGLEWVSVIYPSGGYTGYADSVKGRFTISRDNSKNTLYLQMNSLRAEDTAVYYCAKDRAYGDYVGWNGFDYWGQGTLVTVSS

SEQ ID NO: 712 - protein, 108 aa, Artificial Sequence; identical to SEQ ID NO: 10
  Description of Artificial Sequence: Synthetic polypeptide

SEQ ID NO: 713 - protein, 124 aa, Artificial Sequence
  Description of Artificial Sequence: Synthetic polypeptide
EVQLLESGGGLVQPGGSLRLSCAASGFTFSLYPMIWVRQAPGKGLEWVSYISPSGGFTDYADSVKGRFTISRDNSKNTLYLQMNSLRAEDTAVYYCAKDRAYGDYVGWNGFDYWGQGTLVTVSS

SEQ ID NO: 714 - protein, 108 aa, Artificial Sequence; identical to SEQ ID NO: 10
  Description of Artificial Sequence: Synthetic polypeptide

SEQ ID NO: 715 - protein, 124 aa, Artificial Sequence
  Description of Artificial Sequence: Synthetic polypeptide
EVQLLESGGGLVQPGGSLRLSCAASGFTFSLYPMMWVRQAPGKGLEWVSYIYPSGGGTFYADSVKGRFTISRDNSKNTLYLQMNSLRAEDTAVYYCAKDRAYGDYVGWNGFDYWGQGTLVTVSS

SEQ ID NO: 716 - protein, 108 aa, Artificial Sequence; identical to SEQ ID NO: 10
  Description of Artificial Sequence: Synthetic polypeptide

SEQ ID NO: 717 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSSISPSGGATFYADSVKGRFTISRDNSKNTLYLQMNSLRAEDTAVYYCAKDRAYGDYVGWNGFDYWGQGTLVTVSS

SEQ ID NO: 718 - protein, 108 aa, Artificial Sequence; identical to SEQ ID NO: 10
  Description of Artificial Sequence: Synthetic polypeptide

SEQ ID NO: 719 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSSISPSGGGTFYADSVKGRFTISRDNSKNTLYLQMNSLRAEDTAVYYCAKDRAYGDYVGWNGFDYWGQGTLVTVSS

SEQ ID NO: 720 - protein, 108 aa, Artificial Sequence; identical to SEQ ID NO: 10
  Description of Artificial Sequence: Synthetic polypeptide

SEQ ID NO: 721 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 722 - protein, 108 aa, Artificial Sequence; identical to SEQ ID NO: 10
  Description of Artificial Sequence: Synthetic polypeptide

SEQ ID NO: 723 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 724 - protein, 108 aa, Artificial Sequence; identical to SEQ ID NO: 10
  Description of Artificial Sequence: Synthetic polypeptide

SEQ ID NO: 725 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSWIVPSGGFTLYADSVKGRFTISRDNSKNTLYLQMNSLRAEDTAVYYCAKDRAYGDYVGWNGFDYWGQGTLVTVSS

SEQ ID NO: 726 - protein, 108 aa, Artificial Sequence; identical to SEQ ID NO: 10
  Description of Artificial Sequence: Synthetic polypeptide

SEQ ID NO: 727 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSYISPSGGGTLYADSVKGRFTISRDNSKNTLYLQMNSLRAEDTAVYYCAKDRAYGDYVGWNGFDYWGQGTLVTVSS

SEQ ID NO: 728 - protein, 108 aa, Artificial Sequence; identical to SEQ ID NO: 10
  Description of Artificial Sequence: Synthetic polypeptide

SEQ ID NO: 729 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSYISSSGGGTYYADSVKGRFTISRDNSKNTLYLQMNSLRAEDTAVYYCAKDRAYGDYVGWNGFDYWGQGTLVTVSS

SEQ ID NO: 730 - protein, 108 aa, Artificial Sequence; identical to SEQ ID NO: 10
  Description of Artificial Sequence: Synthetic polypeptide

SEQ ID NO: 731 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSYIVPSGGGTFYADSVKGRFTISRDNSKNTLYLQMNSLRAEDTAVYYCAKDRAYGDYVGWNGFDYWGQGTLVTVSS

SEQ ID NO: 732 - protein, 108 aa, Artificial Sequence; identical to SEQ ID NO: 10
  Description of Artificial Sequence: Synthetic polypeptide

SEQ ID NO: 733 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSYIVSSGGATFYADSVKGRFTISRDNSKNTLYLQMNSLRAEDTAVYYCAKDRAYGDYVGWNGFDYWGQGTLVTVSS

SEQ ID NO: 734 - protein, 108 aa, Artificial Sequence; identical to SEQ ID NO: 10
  Description of Artificial Sequence: Synthetic polypeptide

SEQ ID NO: 735 - protein, 124 aa, Artificial Sequence
  Description of Artificial Sequence: Synthetic polypeptide
EVQLLESGGGLVQPGGSLRLSCAASGFTFSLYPMWWVRQAPGKGLEWVSYIYPSGGATMYADSVKGRFTISRDNSKNTLYLQMNSLRAEDTAVYYCAKDRAYGDYVGWNGFDYWGQGTLVTVSS

SEQ ID NO: 736 - protein, 108 aa, Artificial Sequence; identical to SEQ ID NO: 10
  Description of Artificial Sequence: Synthetic polypeptide

SEQ ID NO: 737 - protein, 124 aa, Artificial Sequence
  Description of Artificial Sequence: Synthetic polypeptide
EVQLLESGGGLVQPGGSLRLSCAASGFTFSLYQMWWVRQAPGKGLEWVSVIYPSGGATYYADSVKGRFTISRDNSKNTLYLQMNSLRAEDTAVYYCAKDRAYGDYVGWNGFDYWGQGTLVTVSS

SEQ ID NO: 738 - protein, 108 aa, Artificial Sequence; identical to SEQ ID NO: 10
  Description of Artificial Sequence: Synthetic polypeptide

SEQ ID NO: 739 - protein, 123 aa, Artificial Sequence
  Description of Artificial Sequence: Synthetic polypeptide
EVQLLESGGGLVQPGGSLRLSCAASGFTFSLYQMWWVRQAPGKGLEWVSVIYPSGGTFYADSVKGRFTISRDNSKNTLYLQMNSLRAEDTAVYYCAKDRAYGDYVGWNGFDYWGQGTLVTVSS

SEQ ID NO: 740 - protein, 108 aa, Artificial Sequence; identical to SEQ ID NO: 10
  Description of Artificial Sequence: Synthetic polypeptide

SEQ ID NO: 741 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVISPSGGGTFYADSVKGRFTISRDNSKNTLYLQMNSLRAEDTAVYYCAKDRAYGDYVGWNGFDYWGQGTLVTVSS

SEQ ID NO: 742 - protein, 108 aa, Artificial Sequence; identical to SEQ ID NO: 10
  Description of Artificial Sequence: Synthetic polypeptide

SEQ ID NO: 743 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYPSGGNTLYADSVKGRFTISRDNSKNTLYLQMNSLRAEDTAVYYCAKDRAYGDYVGWNGFDYWGQGTLVTVSS

SEQ ID NO: 744 - protein, 108 aa, Artificial Sequence; identical to SEQ ID NO: 10
  Description of Artificial Sequence: Synthetic polypeptide

SEQ ID NO: 745 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYPSGGPTFYADSVKGRFTISRDNSKNTLYLQMNSLRAEDTAVYYCAKDRAYGDYVGWNGFDYWGQGTLVTVSS

SEQ ID NO: 746 - protein, 108 aa, Artificial Sequence; identical to SEQ ID NO: 10
  Description of Artificial Sequence: Synthetic polypeptide

SEQ ID NO: 747 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYPSGGYTAYADSVKGRFTISRDNSKNTLYLQMNSLRAEDTAVYYCAKDRAYGDYVGWNGFDYWGQGTLVTVSS

SEQ ID NO: 748 - protein, 108 aa, Artificial Sequence; identical to SEQ ID NO: 10
  Description of Artificial Sequence: Synthetic polypeptide

SEQ ID NO: 749 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYSSGGFTDYADSVKGRFTISRDNSKNTLYLQMNSLRAEDTAVYYCAKDRAYGDYVGWNGFDYWGQGTLVTVSS

SEQ ID NO: 750 - protein, 108 aa, Artificial Sequence; identical to SEQ ID NO: 10
  Description of Artificial Sequence: Synthetic polypeptide

SEQ ID NO: 751 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYSSGGPTFYADSVKGRFTISRDNSKNTLYLQMNSLRAEDTAVYYCAKDRAYGDYVGWNGFDYWGQGTLVTVSS

SEQ ID NO: 752 - protein, 108 aa, Artificial Sequence; identical to SEQ ID NO: 10
  Description of Artificial Sequence: Synthetic polypeptide

SEQ ID NO: 753 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYSSGGVTFYADSVKGRFTISRDNSKNTLYLQMNSLRAEDTAVYYCAKDRAYGDYVGWNGFDYWGQGTLVTVSS

SEQ ID NO: 754 - protein, 108 aa, Artificial Sequence; identical to SEQ ID NO: 10
  Description of Artificial Sequence: Synthetic polypeptide

SEQ ID NO: 755 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYSSGGYTAYADSVKGRFTISRDNSKNTLYLQMNSLRAEDTAVYYCAKDRAYGDYVGWNGFDYWGQGTLVTVSS

SEQ ID NO: 756 - protein, 108 aa, Artificial Sequence; identical to SEQ ID NO: 10
  Description of Artificial Sequence: Synthetic polypeptide

SEQ ID NO: 757 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYSSGGYTDYADSVKGRFTISRDNSKNTLYLQMNSLRAEDTAVYYCAKDRAYGDYVGWNGFDYWGQGTLVTVSS

SEQ ID NO: 758 - protein, 108 aa, Artificial Sequence; identical to SEQ ID NO: 10
  Description of Artificial Sequence: Synthetic polypeptide

SEQ ID NO: 759 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYSSGGYTNYADSVKGRFTISRDNSKNTLYLQMNSLRAEDTAVYYCAKDRAYGDYVGWNGFDYWGQGTLVTVSS

SEQ ID NO: 760 - protein, 108 aa, Artificial Sequence; identical to SEQ ID NO: 10
  Description of Artificial Sequence: Synthetic polypeptide

SEQ ID NO: 761 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSVIYSSGGYTSYADSVKGRFTISRDNSKNTLYLQMNSLRAEDTAVYYCAKDRAYGDYVGWNGFDYWGQGTLVTVSS

SEQ ID NO: 762 - protein, 108 aa, Artificial Sequence; identical to SEQ ID NO: 10
  Description of Artificial Sequence: Synthetic polypeptide

SEQ ID NO: 763 - protein, 124 aa, Artificial Sequence
  Description of Artificial Sequence: Synthetic polypeptide
EVQLLESGGGLVQPGGSLRLSCAASGFTFSMYDMWWVRQAPGKGLEWVSYISSSGGSTLYADSVKGRFTISRDNSKNTLYLQMNSLRAEDTAVYYCAKDRAYGDYVGWNGFDYWGQGTLVTVSS

SEQ ID NO: 764 - protein, 108 aa, Artificial Sequence; identical to SEQ ID NO: 10
  Description of Artificial Sequence: Synthetic polypeptide

SEQ ID NO: 765 - protein, 124 aa, Artificial Sequence
  Description of Artificial Sequence: Synthetic polypeptide
EVQLLESGGGLVQPGGSLRLSCAASGFTFSMYMMIWVRQAPGKGLEWVSSIYPSGGFTSYADSVKGRFTISRDNSKNTLYLQMNSLRAEDTAVYYCAKDRAYGDYVGWNGFDYWGQGTLVTVSS

SEQ ID NO: 766 - protein, 108 aa, Artificial Sequence; identical to SEQ ID NO: 10
  Description of Artificial Sequence: Synthetic polypeptide

SEQ ID NO: 767 - protein, 124 aa, Artificial Sequence
  Description of Artificial Sequence: Synthetic polypeptide
EVQLLESGGGLVQPGGSLRLSCAASGFTFSMYNMWWVRQAPGKGLEWVSSISPSGGATYYADSVKGRFTISRDNSKNTLYLQMNSLRAEDTAVYYCAKDRAYGDYVGWNGFDYWGQGTLVTVSS

SEQ ID NO: 768 - protein, 108 aa, Artificial Sequence; identical to SEQ ID NO: 10
  Description of Artificial Sequence: Synthetic polypeptide

SEQ ID NO: 769 - protein, 124 aa, Artificial Sequence
  Description of Artificial Sequence: Synthetic polypeptide
EVQLLESGGGLVQPGGSLRLSCAASGFTFSMYPIIWVRQAPGKGLEWVSYISPSGGFTGYADSVKGRFTISRDNSKNTLYLQMNSLRAEDTAVYYCAKDRAYGDYVGWNGFDYWGQGTLVTVSS

SEQ ID NO: 770 - protein, 108 aa, Artificial Sequence; identical to SEQ ID NO: 10
  Description of Artificial Sequence: Synthetic polypeptide

SEQ ID NO: 771 - protein, 124 aa, Artificial Sequence
  Description of Artificial Sequence: Synthetic polypeptide
EVQLLESGGGLVQPGGSLRLSCAASGFTFSMYPMFWVRQAPGKGLEWVSYISPSGGWTAYADSVKGRFTISRDNSKNTLYLQMNSLRAEDTAVYYCAKDRAYGDYVGWNGFDYWGQGTLVTVSS

SEQ ID NO: 772 - protein, 108 aa, Artificial Sequence; identical to SEQ ID NO: 10
  Description of Artificial Sequence: Synthetic polypeptide

SEQ ID NO: 773 - protein, 124 aa, Artificial Sequence
  Description of Artificial Sequence: Synthetic polypeptide
EVQLLESGGGLVQPGGSLRLSCAASGFTFSMYPMFWVRQAPGKGLEWVSYISPSGGWTDYADSVKGRFTISRDNSKNTLYLQMNSLRAEDTAVYYCAKDRAYGDYVGWNGFDYWGQGTLVTVSS

SEQ ID NO: 774 - protein, 108 aa, Artificial Sequence; identical to SEQ ID NO: 10
  Description of Artificial Sequence: Synthetic polypeptide

SEQ ID NO: 775 - protein, 124 aa, Artificial Sequence
  Description of Artificial Sequence: Synthetic polypeptide
EVQLLESGGGLVQPGGSLRLSCAASGFTFSMYPMFWVRQAPGKGLEWVSYIVPSGGWTDYADSVKGRFTISRDNSKNTLYLQMNSLRAEDTAVYYCAKDRAYGDYVGWNGFDYWGQGTLVTVSS

SEQ ID NO: 776 - protein, 108 aa, Artificial Sequence; identical to SEQ ID NO: 10
  Description of Artificial Sequence: Synthetic polypeptide

SEQ ID NO: 777 - protein, 124 aa, Artificial Sequence
  Description of Artificial Sequence: Synthetic polypeptide
EVQLLESGGGLVQPGGSLRLSCAASGFTFSMYPMIWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 778 - protein, 108 aa, Artificial Sequence; identical to SEQ ID NO: 10
  Description of Artificial Sequence: Synthetic polypeptide

SEQ ID NO: 779 - protein, 124 aa, Artificial Sequence
  Description of Artificial Sequence: Synthetic polypeptide
EVQLLESGGGLVQPGGSLRLSCAASGFTFSMYPMIWVRQAPGKGLEWVSYIVPSGGFTGYADSVKGRFTISRDNSKNTLYLQMNSLRAEDTAVYYCAKDRAYGDYVGWNGFDYWGQGTLVTVSS

SEQ ID NO: 780 - protein, 108 aa, Artificial Sequence; identical to SEQ ID NO: 10
  Description of Artificial Sequence: Synthetic polypeptide

SEQ ID NO: 781 - protein, 124 aa, Artificial Sequence
  Description of Artificial Sequence: Synthetic polypeptide
EVQLLESGGGLVQPGGSLRLSCAASGFTFSMYPMLWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 782 - protein, 108 aa, Artificial Sequence; identical to SEQ ID NO: 10
  Description of Artificial Sequence: Synthetic polypeptide

SEQ ID NO: 783 - protein, 124 aa, Artificial Sequence
  Description of Artificial Sequence: Synthetic polypeptide
EVQLLESGGGLVQPGGSLRLSCAASGFTFSMYPMTWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 784 - protein, 108 aa, Artificial Sequence; identical to SEQ ID NO: 10
  Description of Artificial Sequence: Synthetic polypeptide

SEQ ID NO: 785 - protein, 124 aa, Artificial Sequence
  Description of Artificial Sequence: Synthetic polypeptide
EVQLLESGGGLVQPGGSLRLSCAASGFTFSMYSMWWVRQAPGKGLEWVSVIYPSGGFTDYADSVKGRFTISRDNSKNTLYLQMNSLRAEDTAVYYCAKDRAYGDYVGWNGFDYWGQGTLVTVSS

SEQ ID NO: 786 - protein, 108 aa, Artificial Sequence; identical to SEQ ID NO: 10
  Description of Artificial Sequence: Synthetic polypeptide

SEQ ID NO: 787 - protein, 124 aa, Artificial Sequence
  Description of Artificial Sequence: Synthetic polypeptide
EVQLLESGGGLVQPGGSLRLSCAASGFTFSMYWMLWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 788 - protein, 108 aa, Artificial Sequence; identical to SEQ ID NO: 10
  Description of Artificial Sequence: Synthetic polypeptide

SEQ ID NO: 789 - protein, 124 aa, Artificial Sequence
  Description of Artificial Sequence: Synthetic polypeptide
EVQLLESGGGLVQPGGSLRLSCAASGFTFSMYWMWWVRQAPGKGLEWVSSISSSGGYTGYADSVKGRFTISRDNSKNTLYLQMNSLRAEDTAVYYCAKDRAYGDYVGWNGFDYWGQGTLVTVSS

SEQ ID NO: 790 - protein, 108 aa, Artificial Sequence; identical to SEQ ID NO: 10
  Description of Artificial Sequence: Synthetic polypeptide

SEQ ID NO: 791 - protein, 123 aa, Artificial Sequence
  Description of Artificial Sequence: Synthetic polypeptide
EVQLLESGGGLVQPGGSLRLSCAASGFTFSNYAMWWVRQAPGKGLEWVSYISPSGATYYADSVKGRFTISRDNSKNTLYLQMNSLRAEDTAVYYCAKDRAYGDYVGWNGFDYWGQGTLVTVSS

SEQ ID NO: 792 - protein, 108 aa, Artificial Sequence; identical to SEQ ID NO: 10
  Description of Artificial Sequence: Synthetic polypeptide

SEQ ID NO: 793 - protein, 124 aa, Artificial Sequence
  Description of Artificial Sequence: Synthetic polypeptide
EVQLLESGGGLVQPGGSLRLSCAASGFTFSNYAMWWVRQAPGKGLEWVSYISPSGGSTYYADSVKGRFTISRDNSKNTLYLQMNSLRAEDTAVYYCAKDRAYGDYVGWNGFDYWGQGTLVTVSS

SEQ ID NO: 794 - protein, 108 aa, Artificial Sequence; identical to SEQ ID NO: 10
  Description of Artificial Sequence: Synthetic polypeptide

SEQ ID NO: 795 - protein, 124 aa, Artificial Sequence
  Description of Artificial Sequence: Synthetic polypeptide
EVQLLESGGGLVQPGGSLRLSCAASGFTFSNYDMAWVRQAPGKGLEWVSWISSSGGFTDYADSVKGRFTISRDNSKNTLYLQMNSLRAEDTAVYYCAKDRAYGDYVGWNGFDYWGQGTLVTVSS

SEQ ID NO: 796 - protein, 108 aa, Artificial Sequence; identical to SEQ ID NO: 10
  Description of Artificial Sequence: Synthetic polypeptide

SEQ ID NO: 797 - protein, 124 aa, Artificial Sequence
  Description of Artificial Sequence: Synthetic polypeptide
EVQLLESGGGLVQPGGSLRLSCAASGFTFSNYDMIWVRQAPGKGLEWVSVISPSGGWTSYADSVKGRFTISRDNSKNTLYLQMNSLRAEDTAVYYCAKDRAYGDYVGWNGFDYWGQGTLVTVSS

SEQ ID NO: 798 - protein, 108 aa, Artificial Sequence; identical to SEQ ID NO: 10
  Description of Artificial Sequence: Synthetic polypeptide

SEQ ID NO: 799 - protein, 124 aa, Artificial Sequence
  Description of Artificial Sequence: Synthetic polypeptide
EVQLLESGGGLVQPGGSLRLSCAASGFTFSNYDMIWVRQAPGKGLEWVSYIVPSGGYTAYADSVKGRFTISRDNSKNTLYLQMNSLRAEDTAVYYCAKDRAYGDYVGWNGFDYWGQGTLVTVSS

SEQ ID NO: 800 - protein, 108 aa, Artificial Sequence; identical to SEQ ID NO: 10
  Description of Artificial Sequence: Synthetic polypeptide

SEQ ID NO: 801 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVISPSGGFTGYADSVKGRFTISRDNSKNTLYLQMNSLRAEDTAVYYCAKDRAYGDYVGWNGFDYWGQGTLVTVSS

SEQ ID NO: 802 - protein, 108 aa, Artificial Sequence; identical to SEQ ID NO: 10
  Description of Artificial Sequence: Synthetic polypeptide

SEQ ID NO: 803 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVISSSGGYTGYADSVKGRFTISRDNSKNTLYLQMNSLRAEDTAVYYCAKDRAYGDYVGWNGFDYWGQGTLVTVSS

SEQ ID NO: 804 - protein, 108 aa, Artificial Sequence; identical to SEQ ID NO: 10
  Description of Artificial Sequence: Synthetic polypeptide

SEQ ID NO: 805 - protein, 123 aa, Artificial Sequence
  Description of Artificial Sequence: Synthetic polypeptide
EVQLLESGGGLVQPGGSLRLSCAASGFTFSNYDMWWVRQAPGKGLEWVSVISSSGMTYYADSVKGRFTISRDNSKNTLYLQMNSLRAEDTAVYYCAKDRAYGDYVGWNGFDYWGQGTLVTVSS

SEQ ID NO: 806 - protein, 108 aa, Artificial Sequence; identical to SEQ ID NO: 10
  Description of Artificial Sequence: Synthetic polypeptide

SEQ ID NO: 807 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVIVPSGGATYYADSVKGRFTISRDNSKNTLYLQMNSLRAEDTAVYYCAKDRAYGDYVGWNGFDYWGQGTLVTVSS

SEQ ID NO: 808 - protein, 108 aa, Artificial Sequence; identical to SEQ ID NO: 10
  Description of Artificial Sequence: Synthetic polypeptide

SEQ ID NO: 809 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 810 - protein, 108 aa, Artificial Sequence; identical to SEQ ID NO: 10
  Description of Artificial Sequence: Synthetic polypeptide

SEQ ID NO: 811 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVIYPSGGITYYADSVKGRFTISRDNSKNTLYLQMNSLRAEDTAVYYCAKDRAYGDYVGWNGFDYWGQGTLVTVSS

SEQ ID NO: 812 - protein, 108 aa, Artificial Sequence; identical to SEQ ID NO: 10
  Description of Artificial Sequence: Synthetic polypeptide

SEQ ID NO: 813 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVIYPSGGPTYYADSVKGRFTISRDNSKNTLYLQMNSLRAEDTAVYYCAKDRAYGDYVGWNGFDYWGQGTLVTVSS

SEQ ID NO: 814 - protein, 108 aa, Artificial Sequence; identical to SEQ ID NO: 10
  Description of Artificial Sequence: Synthetic polypeptide

SEQ ID NO: 815 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVIYPSGGYTVYADSVKGRFTISRDNSKNTLYLQMNSLRAEDTAVYYCAKDRAYGDYVGWNGFDYWGQGTLVTVSS

SEQ ID NO: 816 - protein, 108 aa, Artificial Sequence; identical to SEQ ID NO: 10
  Description of Artificial Sequence: Synthetic polypeptide

SEQ ID NO: 817 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVIYSSGGPTYYADSVKGRFTISRDNSKNTLYLQMNSLRAEDTAVYYCAKDRAYGDYVGWNGFDYWGQGTLVTVSS

SEQ ID NO: 818 - protein, 108 aa, Artificial Sequence; identical to SEQ ID NO: 10
  Description of Artificial Sequence: Synthetic polypeptide

SEQ ID NO: 819 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSVIYSSGGYTAYADSVKGRFTISRDNSKNTLYLQMNSLRAEDTAVYYCAKDRAYGDYVGWNGFDYWGQGTLVTVSS

SEQ ID NO: 820 - protein, 108 aa, Artificial Sequence; identical to SEQ ID NO: 10
  Description of Artificial Sequence: Synthetic polypeptide

SEQ ID NO: 821 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSWISSSGGATIYADSVKGRFTISRDNSKNTLYLQMNSLRAEDTAVYYCAKDRAYGDYVGWNGFDYWGQGTLVTVSS

SEQ ID NO: 822 - protein, 108 aa, Artificial Sequence; identical to SEQ ID NO: 10
  Description of Artificial Sequence: Synthetic polypeptide

SEQ ID NO: 823 - protein, 124 aa, Artificial Sequence
  Description of Artificial Sequence: Synthetic polypeptide
EVQLLESGGGLVQPGGSLRLSCAASGFTFSNYDMWWVRQAPGKGLEWVSYISSSGGATLYADSVKGRFTISRDNSKNTLYLQMNSLRAEDTAVYYCAKDRAYGDYVGWNGFDYWGQGTLVTVSS

SEQ ID NO: 824 - protein, 108 aa, Artificial Sequence; identical to SEQ ID NO: 10
  Description of Artificial Sequence: Synthetic polypeptide

SEQ ID NO: 825 - protein, 124 aa, Artificial Sequence
  Description of Artificial Sequence: Synthetic polypeptide
EVQLLESGGGLVQPGGSLRLSCAASGFTFSNYEMWWVRQAPGKGLEWVSVIYSSGSATFYADSVKGRFTISRDNSKNTLYLQMNSLRAEDTAVYYCAKDRAYGDYVGWNGFDYWGQGTLVTVSS

SEQ ID NO: 826 - protein, 108 aa, Artificial Sequence; identical to SEQ ID NO: 10
  Description of Artificial Sequence: Synthetic polypeptide

SEQ ID NO: 827 - protein, 124 aa, Artificial Sequence
  Description of Artificial Sequence: Synthetic polypeptide
EVQLLESGGGLVQPGGSLRLSCAASGFTFSNYIMWWVRQAPGKGLEWVSSIYPSGGATLYADSVKGRFTISRDNSKNTLYLQMNSLRAEDTAVYYCAKDRAYGDYVGWNGFDYWGQGTLVTVSS

SEQ ID NO: 828 - protein, 108 aa, Artificial Sequence; identical to SEQ ID NO: 10
  Description of Artificial Sequence: Synthetic polypeptide

SEQ ID NO: 829 - protein, 124 aa, Artificial Sequence
  Description of Artificial Sequence: Synthetic polypeptide
EVQLLESGGGLVQPGGSLRLSCAASGFTFSNYMMIWVRQAPGKGLEWVSSIYPSGGYTGYADSVKGRFTISRDNSKNTLYLQMNSLRAEDTAVYYCAKDRAYGDYVGWNGFDYWGQGTLVTVSS

SEQ ID NO: 830 - protein, 108 aa, Artificial Sequence; identical to SEQ ID NO: 10
  Description of Artificial Sequence: Synthetic polypeptide

SEQ ID NO: 831 - protein, 124 aa, Artificial Sequence
  Description of Artificial Sequence: Synthetic polypeptide
EVQLLESGGGLVQPGGSLRLSCAASGFTFSNYMMIWVRQAPGKGLEWVSSIYSSGGFTSYADSVKGRFTISRDNSKNTLYLQMNSLRAEDTAVYYCAKDRAYGDYVGWNGFDYWGQGTLVTVSS

SEQ ID NO: 832 - protein, 108 aa, Artificial Sequence; identical to SEQ ID NO: 10
  Description of Artificial Sequence: Synthetic polypeptide

SEQ ID NO: 833 - protein, 124 aa, Artificial Sequence
  Description of Artificial Sequence: Synthetic polypeptide
EVQLLESGGGLVQPGGSLRLSCAASGFTFSNYMMWWVRQAPGKGLEWVSSIGPSGGGTFYADSVKGRFTISRDNSKNTLYLQMNSLRAEDTAVYYCAKDRAYGDYVGWNGFDYWGQGTLVTVSS

SEQ ID NO: 834 - protein, 108 aa, Artificial Sequence; identical to SEQ ID NO: 10
  Description of Artificial Sequence: Synthetic polypeptide

SEQ ID NO: 835 - protein, 124 aa, Artificial Sequence
  Description of Artificial Sequence: Synthetic polypeptide
EVQLLESGGGLVQPGGSLRLSCAASGFTFSNYMMWWVRQAPGKGLEWVSSIYSSGGGTFYADSVKGRFTISRDNSKNTLYLQMNSLRAEDTAVYYCAKDRAYGDYVGWNGFDYWGQGTLVTVSS

SEQ ID NO: 836 - protein, 108 aa, Artificial Sequence; identical to SEQ ID NO: 10
  Description of Artificial Sequence: Synthetic polypeptide

SEQ ID NO: 837 - protein, 124 aa, Artificial Sequence
  Description of Artificial Sequence: Synthetic polypeptide
EVQLLESGGGLVQPGGSLRLSCAASGFTFSNYMMWWVRQAPGKGLEWVSVISPSGGATYYADSVKGRFTISRDNSKNTLYLQMNSLRAEDTAVYYCAKDRAYGDYVGWNGFDYWGQGTLVTVSS

SEQ ID NO: 838 - protein, 108 aa, Artificial Sequence; identical to SEQ ID NO: 10
  Description of Artificial Sequence: Synthetic polypeptide

SEQ ID NO: 839 - protein, 124 aa, Artificial Sequence
  Description of Artificial Sequence: Synthetic polypeptide
EVQLLESGGGLVQPGGSLRLSCAASGFTFSNYNMMWVRQAPGKGLEWVSYISSSGGYTGYADSVKGRFTISRDNSKNTLYLQMNSLRAEDTAVYYCAKDRAYGDYVGWNGFDYWGQGTLVTVSS

SEQ ID NO: 840 - protein, 108 aa, Artificial Sequence; identical to SEQ ID NO: 10
  Description of Artificial Sequence: Synthetic polypeptide

SEQ ID NO: 841 - protein, 124 aa, Artificial Sequence
  Description of Artificial Sequence: Synthetic polypeptide
EVQLLESGGGLVQPGGSLRLSCAASGFTFSNYNMWWVRQAPGKGLEWVSVIYPSGGPTFYADSVKGRFTISRDNSKNTLYLQMNSLRAEDTAVYYCAKDRAYGDYVGWNGFDYWGQGTLVTVSS

SEQ ID NO: 842 - protein, 108 aa, Artificial Sequence; identical to SEQ ID NO: 10
  Description of Artificial Sequence: Synthetic polypeptide

SEQ ID NO: 843 - protein, 124 aa, Artificial Sequence
  Description of Artificial Sequence: Synthetic polypeptide
EVQLLESGGGLVQPGGSLRLSCAASGFTFSNYNMWWVRQAPGKGLEWVSYISPSGGGTLYADSVKGRFTISRDNSKNTLYLQMNSLRAEDTAVYYCAKDRAYGDYVGWNGFDYWGQGTLVTVSS

SEQ ID NO: 844 - protein, 108 aa, Artificial Sequence; identical to SEQ ID NO: 10
  Description of Artificial Sequence: Synthetic polypeptide

SEQ ID NO: 845 - protein, 124 aa, Artificial Sequence
  Description of Artificial Sequence: Synthetic polypeptide
EVQLLESGGGLVQPGGSLRLSCAASGFTFSNYPMFWVRQAPGKGLEWVSYISPSGGWTSYADSVKGRFTISRDNSKNTLYLQMNSLRAEDTAVYYCAKDRAYGDYVGWNGFDYWGQGTLVTVSS

SEQ ID NO: 846 - protein, 108 aa, Artificial Sequence; identical to SEQ ID NO: 10
  Description of Artificial Sequence: Synthetic polypeptide

SEQ ID NO: 847 - protein, 124 aa, Artificial Sequence
  Description of Artificial Sequence: Synthetic polypeptide
EVQLLESGGGLVQPGGSLRLSCAASGFTFSNYPMIWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 848 - protein, 108 aa, Artificial Sequence; identical to SEQ ID NO: 10
  Description of Artificial Sequence: Synthetic polypeptide

SEQ ID NO: 849 - protein, 124 aa, Artificial Sequence
  Description of Artificial Sequence: Synthetic polypeptide
EVQLLESGGGLVQPGGSLRLSCAASGFTFSNYPMIWVRQAPGKGLEWVSYISSSGGYTGYADSVKGRFTISRDNSKNTLYLQMNSLRAEDTAVYYCAKDRAYGDYVGWNGFDYWGQGTLVTVSS

SEQ ID NO: 850 - protein, 108 aa, Artificial Sequence; identical to SEQ ID NO: 10
  Description of Artificial Sequence: Synthetic polypeptide

SEQ ID NO: 851 - protein, 124 aa, Artificial Sequence
  Description of Artificial Sequence: Synthetic polypeptide
EVQLLESGGGLVQPGGSLRLSCAASGFTFSNYPMIWVRQAPGKGLEWVSYIVPSGGFTSYADSVKGRFTISRDNSKNTLYLQMNSLRAEDTAVYYCAKDRAYGDYVGWNGFDYWGQGTLVTVSS

SEQ ID NO: 852 - protein, 108 aa, Artificial Sequence; identical to SEQ ID NO: 10
  Description of Artificial Sequence: Synthetic polypeptide

SEQ ID NO: 853 - protein, 124 aa, Artificial Sequence
  Description of Artificial Sequence: Synthetic polypeptide
EVQLLESGGGLVQPGGSLRLSCAASGFTFSNYPMIWVRQAPGKGLEWVSYIYPSGGGTYYADSVKGRFTISRDNSKNTLYLQMNSLRAEDTAVYYCAKDRAYGDYVGWNGFDYWGQGTLVTVSS

SEQ ID NO: 854 - protein, 108 aa, Artificial Sequence; identical to SEQ ID NO: 10
  Description of Artificial Sequence: Synthetic polypeptide

SEQ ID NO: 855 - protein, 123 aa, Artificial Sequence
  Description of Artificial Sequence: Synthetic polypeptide
EVQLLESGGGLVQPGGSLRLSCAASGFTFSNYPMIWVRQAPGKGLEWVSYIYPSGGTFYADSVKGRFTISRDNSKNTLYLQMNSLRAEDTAVYYCAKDRAYGDYVGWNGFDYWGQGTLVTVSS

SEQ ID NO: 856 - protein, 108 aa, Artificial Sequence; identical to SEQ ID NO: 10
  Description of Artificial Sequence: Synthetic polypeptide

SEQ ID NO: 857 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSSISPSGGSTYYADSVKGRFTISRDNSKNTLYLQMNSLRAEDTAVYYCAKDRAYGDYVGWNGFDYWGQGTLVTVSS

SEQ ID NO: 858 - protein, 108 aa, Artificial Sequence; identical to SEQ ID NO: 10
  Description of Artificial Sequence: Synthetic polypeptide

SEQ ID NO: 859 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSSIVPSGGATYYADSVKGRFTISRDNSKNTLYLQMNSLRAEDTAVYYCAKDRAYGDYVGWNGFDYWGQGTLVTVSS

SEQ ID NO: 860 - protein, 108 aa, Artificial Sequence; identical to SEQ ID NO: 10
  Description of Artificial Sequence: Synthetic polypeptide

SEQ ID NO: 861 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 862 - protein, 108 aa, Artificial Sequence; identical to SEQ ID NO: 10
  Description of Artificial Sequence: Synthetic polypeptide

SEQ ID NO: 863 - protein, 125 aa, Artificial Sequence
  Description of Artificial Sequence: Synthetic polypeptide
EVQLLESGGGLVQPGGSLRLSCAASGFTFSNYPMWWVRQAPGKGLEWVSSIYPSGGKATYYADSVKGRFTISRDNSKNTLYLQMNSLRAEDTAVYYCAKDRAYGDYVGWNGFDYWGQGTLVTVSS

SEQ ID NO: 864 - protein, 108 aa, Artificial Sequence; identical to SEQ ID NO: 10
  Description of Artificial Sequence: Synthetic polypeptide

SEQ ID NO: 865 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSSIYPSGGPTFYADSVKGRFTISRDNSKNTLYLQMNSLRAEDTAVYYCAKDRAYGDYVGWNGFDYWGQGTLVTVSS

SEQ ID NO: 866 - protein, 108 aa, Artificial Sequence; identical to SEQ ID NO: 10
  Description of Artificial Sequence: Synthetic polypeptide

SEQ ID NO: 867 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSSIYSSGGATFYADSVKGRFTISRDNSKNTLYLQMNSLRAEDTAVYYCAKDRAYGDYVGWNGFDYWGQGTLVTVSS

SEQ ID NO: 868 - protein, 108 aa, Artificial Sequence; identical to SEQ ID NO: 10
  Description of Artificial Sequence: Synthetic polypeptide

SEQ ID NO: 869 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSVIYPSGGYTAYADSVKGRFTISRDNSKNTLYLQMNSLRAEDTAVYYCAKDRAYGDYVGWNGFDYWGQGTLVTVSS

SEQ ID NO: 870 - protein, 108 aa, Artificial Sequence; identical to SEQ ID NO: 10
  Description of Artificial Sequence: Synthetic polypeptide

SEQ ID NO: 871 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSYIGPSGGGTLYADSVKGRFTISRDNSKNTLYLQMNSLRAEDTAVYYCAKDRAYGDYVGWNGFDYWGQGTLVTVSS

SEQ ID NO: 872 - protein, 108 aa, Artificial Sequence; identical to SEQ ID NO: 10
  Description of Artificial Sequence: Synthetic polypeptide

SEQ ID NO: 873 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSYIRPSGGPTWYADSVKGRFTISRDNSKNTLYLQMNSLRAEDTAVYYCAKDRAYGDYVGWNGFDYWGQGTLVTVSS

SEQ ID NO: 874 - protein, 108 aa, Artificial Sequence; identical to SEQ ID NO: 10
  Description of Artificial Sequence: Synthetic polypeptide

SEQ ID NO: 875 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 876 - protein, 108 aa, Artificial Sequence; identical to SEQ ID NO: 10
  Description of Artificial Sequence: Synthetic polypeptide

SEQ ID NO: 877 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSYISPSGGGTLYADSVKGRFTISRDNSKNTLYLQMNSLRAEDTAVYYCAKDRAYGDYVGWNGFDYWGQGTLVTVSS

SEQ ID NO: 878 - protein, 108 aa, Artificial Sequence; identical to SEQ ID NO: 10
  Description of Artificial Sequence: Synthetic polypeptide

SEQ ID NO: 879 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSYIVPSGGATFYADSVKGRFTISRDNSKNTLYLQMNSLRAEDTAVYYCAKDRAYGDYVGWNGFDYWGQGTLVTVSS

SEQ ID NO: 880 - protein, 108 aa, Artificial Sequence; identical to SEQ ID NO: 10
  Description of Artificial Sequence: Synthetic polypeptide

SEQ ID NO: 881 - protein, 124 aa, Artificial Sequence
  Description of Artificial Sequence: Synthetic polypeptide
EVQLLESGGGLVQPGGSLRLSCAASGFTFSNYPMWWVRQAPGKGLEWVSYIVPSGGMTYYADSVKGRFTISRDNSKNTLYLQMNSLRAEDTAVYYCAKDRAYGDYVGWNGFDYWGQGTLVTVSS

SEQ ID NO: 882 - protein, 108 aa, Artificial Sequence; identical to SEQ ID NO: 10
  Description of Artificial Sequence: Synthetic polypeptide

SEQ ID NO: 883 - protein, 124 aa, Artificial Sequence
  Description of Artificial Sequence: Synthetic polypeptide
EVQLLESGGGLVQPGGSLRLSCAASGFTFSNYSMWWVRQAPGKGLEWVSVIYPSGGYTSYADSVKGRFTISRDNSKNTLYLQMNSLRAEDTAVYYCAKDRAYGDYVGWNGFDYWGQGTLVTVSS

SEQ ID NO: 884 - protein, 108 aa, Artificial Sequence; identical to SEQ ID NO: 10
  Description of Artificial Sequence: Synthetic polypeptide

SEQ ID NO: 885 - protein, 124 aa, Artificial Sequence
  Description of Artificial Sequence: Synthetic polypeptide
EVQLLESGGGLVQPGGSLRLSCAASGFTFSNYYMIWVRQAPGKGLEWVSYISPSGGGTYYADSVKGRFTISRDNSKNTLYLQMNSLRAEDTAVYYCAKDRAYGDYVGWNGFDYWGQGTLVTVSS

SEQ ID NO: 886 - protein, 108 aa, Artificial Sequence; identical to SEQ ID NO: 10
  Description of Artificial Sequence: Synthetic polypeptide

SEQ ID NO: 887 - protein, 124 aa, Artificial Sequence
  Description of Artificial Sequence: Synthetic polypeptide
EVQLLESGGGLVQPGGSLRLSCAASGFTFSPYAMWWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 888 - protein, 108 aa, Artificial Sequence; identical to SEQ ID NO: 10
  Description of Artificial Sequence: Synthetic polypeptide

SEQ ID NO: 889 - protein, 124 aa, Artificial Sequence
  Description of Artificial Sequence: Synthetic polypeptide
EVQLLESGGGLVQPGGSLRLSCAASGFTFSPYDMWWVRQAPGKGLEWVSVISPSGGATFYADSVKGRFTISRDNSKNTLYLQMNSLRAEDTAVYYCAKDRAYGDYVGWNGFDYWGQGTLVTVSS

SEQ ID NO: 890 - protein, 108 aa, Artificial Sequence; identical to SEQ ID NO: 10
  Description of Artificial Sequence: Synthetic polypeptide

SEQ ID NO: 891 - protein, 124 aa, Artificial Sequence
  Description of Artificial Sequence: Synthetic polypeptide
EVQLLESGGGLVQPGGSLRLSCAASGFTFSPYDMWWVRQAPGKGLEWVSVISPSGGYTGYADSVKGRFTISRDNSKNTLYLQMNSLRAEDTAVYYCAKDRAYGDYVGWNGFDYWGQGTLVTVSS

SEQ ID NO: 892 - protein, 108 aa, Artificial Sequence; identical to SEQ ID NO: 10
  Description of Artificial Sequence: Synthetic polypeptide

SEQ ID NO: 893 - protein, 124 aa, Artificial Sequence
  Description of Artificial Sequence: Synthetic polypeptide
EVQLLESGGGLVQPGGSLRLSCAASGFTFSPYDMWWVRQAPGKGLEWVSVISSSGGFTDYADSVKGRFTISRDNSKNTLYLQMNSLRAEDTAVYYCAKDRAYGDYVGWNGFDYWGQGTLVTVSS

SEQ ID NO: 894 - protein, 108 aa, Artificial Sequence; identical to SEQ ID NO: 10
  Description of Artificial Sequence: Synthetic polypeptide

SEQ ID NO: 895 - protein, 124 aa, Artificial Sequence
  Description of Artificial Sequence: Synthetic polypeptide
EVQLLESGGGLVQPGGSLRLSCAASGFTFSPYMMFWVRQAPGKGLEWVSSISSSGGGTFYADSVKGRFTISRDNSKNTLYLQMNSLRAEDTAVYYCAKDRAYGDYVGWNGFDYWGQGTLVTVSS

SEQ ID NO: 896 - protein, 108 aa, Artificial Sequence; identical to SEQ ID NO: 10
  Description of Artificial Sequence: Synthetic polypeptide

SEQ ID NO: 897 - protein, 124 aa, Artificial Sequence
  Description of Artificial Sequence: Synthetic polypeptide
EVQLLESGGGLVQPGGSLRLSCAASGFTFSPYMMIWVRQAPGKGLEWVSSISSSGGYTGYADSVKGRFTISRDNSKNTLYLQMNSLRAEDTAVYYCAKDRAYGDYVGWNGFDYWGQGTLVTVSS

SEQ ID NO: 898 - protein, 108 aa, Artificial Sequence; identical to SEQ ID NO: 10
  Description of Artificial Sequence: Synthetic polypeptide

SEQ ID NO: 899 - protein, 124 aa, Artificial Sequence
  Description of Artificial Sequence: Synthetic polypeptide
EVQLLESGGGLVQPGGSLRLSCAASGFTFSPYMMSWVRQAPGKGLEWVSSIYSSGGATFYADSVKGRFTISRDNSKNTLYLQMNSLRAEDTAVYYCAKDRAYGDYVGWNGFDYWGQGTLVTVSS

SEQ ID NO: 900 - protein, 108 aa, Artificial Sequence; identical to SEQ ID NO: 10
  Description of Artificial Sequence: Synthetic polypeptide

SEQ ID NO: 901 - protein, 124 aa, Artificial Sequence
  Description of Artificial Sequence: Synthetic polypeptide
EVQLLESGGGLVQPGGSLRLSCAASGFTFSPYMMWWVRQAPGKGLEWVSSISSSGGGTFYADSVKGRFTISRDNSKNTLYLQMNSLRAEDTAVYYCAKDRAYGDYVGWNGFDYWGQGTLVTVSS

SEQ ID NO: 902 - protein, 108 aa, Artificial Sequence; identical to SEQ ID NO: 10
  Description of Artificial Sequence: Synthetic polypeptide

SEQ ID NO: 903 - protein, 124 aa, Artificial Sequence
  Description of Artificial Sequence: Synthetic polypeptide
EVQLLESGGGLVQPGGSLRLSCAASGFTFSPYNMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 904 - protein, 108 aa, Artificial Sequence; identical to SEQ ID NO: 10
  Description of Artificial Sequence: Synthetic polypeptide

SEQ ID NO: 905 - protein, 124 aa, Artificial Sequence
  Description of Artificial Sequence: Synthetic polypeptide
EVQLLESGGGLVQPGGSLRLSCAASGFTFSPYPMFWVRQAPGKGLEWVSSISPSGGATYYADSVKGRFTISRDNSKNTLYLQMNSLRAEDTAVYYCAKDRAYGDYVGWNGFDYWGQGTLVTVSS

SEQ ID NO: 906 - protein, 108 aa, Artificial Sequence; identical to SEQ ID NO: 10
  Description of Artificial Sequence: Synthetic polypeptide

SEQ ID NO: 907 - protein, 124 aa, Artificial Sequence
  Description of Artificial Sequence: Synthetic polypeptide
EVQLLESGGGLVQPGGSLRLSCAASGFTFSPYPMIWVRQAPGKGLEWVSYIGSSGGYTSYADSVKGRFTISRDNSKNTLYLQMNSLRAEDTAVYYCAKDRAYGDYVGWNGFDYWGQGTLVTVSS

SEQ ID NO: 908 - protein, 108 aa, Artificial Sequence; identical to SEQ ID NO: 10
  Description of Artificial Sequence: Synthetic polypeptide

SEQ ID NO: 909 - protein, 124 aa, Artificial Sequence
  Description of Artificial Sequence: Synthetic polypeptide
EVQLLESGGGLVQPGGSLRLSCAASGFTFSPYPMIWVRQAPGKGLEWVSYISPSGGFTDYADSVKGRFTISRDNSKNTLYLQMNSLRAEDTAVYYCAKDRAYGDYVGWNGFDYWGQGTLVTVSS

SEQ ID NO: 910 - protein, 108 aa, Artificial Sequence; identical to SEQ ID NO: 10
  Description of Artificial Sequence: Synthetic polypeptide

SEQ ID NO: 911 - protein, 124 aa, Artificial Sequence
  Description of Artificial Sequence: Synthetic polypeptide
EVQLLESGGGLVQPGGSLRLSCAASGFTFSPYPMIWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 912 - protein, 108 aa, Artificial Sequence; identical to SEQ ID NO: 10
  Description of Artificial Sequence: Synthetic polypeptide

SEQ ID NO: 913 - protein, 124 aa, Artificial Sequence
  Description of Artificial Sequence: Synthetic polypeptide
EVQLLESGGGLVQPGGSLRLSCAASGFTFSPYPMIWVRQAPGKGLEWVSYISSSGGGTYYADSVKGRFTISRDNSKNTLYLQMNSLRAEDTAVYYCAKDRAYGDYVGWNGFDYWGQGTLVTVSS

SEQ ID NO: 914 - protein, 108 aa, Artificial Sequence; identical to SEQ ID NO: 10
  Description of Artificial Sequence: Synthetic polypeptide

SEQ ID NO: 915 - protein, 124 aa, Artificial Sequence
  Description of Artificial Sequence: Synthetic polypeptide
EVQLLESGGGLVQPGGSLRLSCAASGFTFSPYPMIWVRQAPGKGLEWVSYISSSGGYTDYADSVKGRFTISRDNSKNTLYLQMNSLRAEDTAVYYCAKDRAYGDYVGWNGFDYWGQGTLVTVSS

SEQ ID NO: 916 - protein, 108 aa, Artificial Sequence; identical to SEQ ID NO: 10
  Description of Artificial Sequence: Synthetic polypeptide

SEQ ID NO: 917 - protein, 124 aa, Artificial Sequence
  Description of Artificial Sequence: Synthetic polypeptide
EVQLLESGGGLVQPGGSLRLSCAASGFTFSPYPMWWVRQAPGKGLEWVSYISPSGGWTDYADSVKGRFTISRDNSKNTLYLQMNSLRAEDTAVYYCAKDRAYGDYVGWNGFDYWGQGTLVTVSS

SEQ ID NO: 918 - protein, 108 aa, Artificial Sequence; identical to SEQ ID NO: 10
  Description of Artificial Sequence: Synthetic polypeptide

SEQ ID NO: 919 - protein, 124 aa, Artificial Sequence
  Description of Artificial Sequence: Synthetic polypeptide
EVQLLESGGGLVQPGGSLRLSCAASGFTFSPYPMWWVRQAPGKGLEWVSYIVPSGGKTFYADSVKGRFTISRDNSKNTLYLQMNSLRAEDTAVYYCAKDRAYGDYVGWNGFDYWGQGTLVTVSS

SEQ ID NO: 920 - protein, 108 aa, Artificial Sequence; identical to SEQ ID NO: 10
  Description of Artificial Sequence: Synthetic polypeptide

SEQ ID NO: 921 - protein, 124 aa, Artificial Sequence
  Description of Artificial Sequence: Synthetic polypeptide
EVQLLESGGGLVQPGGSLRLSCAASGFTFSQYAMIWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 922 - protein, 108 aa, Artificial Sequence; identical to SEQ ID NO: 10
  Description of Artificial Sequence: Synthetic polypeptide

SEQ ID NO: 923 - protein, 124 aa, Artificial Sequence
  Description of Artificial Sequence: Synthetic polypeptide
EVQLLESGGGLVQPGGSLRLSCAASGFTFSQYDMIWVRQAPGKGLEWVSYIGSSGGSTIYADSVKGRFTISRDNSKNTLYLQMNSLRAEDTAVYYCAKDRAYGDYVGWNGFDYWGQGTLVTVSS

SEQ ID NO: 924 - protein, 108 aa, Artificial Sequence; identical to SEQ ID NO: 10
  Description of Artificial Sequence: Synthetic polypeptide

SEQ ID NO: 925 - protein, 124 aa, Artificial Sequence
  Description of Artificial Sequence: Synthetic polypeptide
EVQLLESGGGLVQPGGSLRLSCAASGFTFSQYDMWWFRQAPGKGLEWVSVISPSGGHTSYADSVKGRFTISRDNSKNTLYLQMNSLRAEDTAVYYCAKDRAYGDYVGWNGFDYWGQGTLVTVSS

SEQ ID NO: 926 - protein, 108 aa, Artificial Sequence; identical to SEQ ID NO: 10
  Description of Artificial Sequence: Synthetic polypeptide

SEQ ID NO: 927 - protein, 124 aa, Artificial Sequence
  Description of Artificial Sequence: Synthetic polypeptide
EVQLLESGGGLVQPGGSLRLSCAASGFTFSQYDMWWVRQAPGKGLEWVSVISSSGGATWYADSVKGRFTISRDNSKNTLYLQMNSLRAEDTAVYYCAKDRAYGDYVGWNGFDYWGQGTLVTVSS

SEQ ID NO: 928 - protein, 108 aa, Artificial Sequence; identical to SEQ ID NO: 10
  Description of Artificial Sequence: Synthetic polypeptide

SEQ ID NO: 929 - protein, 124 aa, Artificial Sequence
  Description of Artificial Sequence: Synthetic polypeptide
EVQLLESGGGLVQPGGSLRLSCAASGFTFSQYDMWWVRQAPGKGLEWVSVIYPSGGPTFYADSVKGRFTISRDNSKNTLYLQMNSLRAEDTAVYYCAKDRAYGDYVGWNGFDYWGQGTLVTVSS

SEQ ID NO: 930 - protein, 108 aa, Artificial Sequence; identical to SEQ ID NO: 10
  Description of Artificial Sequence: Synthetic polypeptide

SEQ ID NO: 931 - protein, 124 aa, Artificial Sequence
  Description of Artificial Sequence: Synthetic polypeptide
EVQLLESGGGLVQPGGSLRLSCAASGFTFSQYDMWWVRQAPGKGLEWVSVIYPSGGTTFYADSVKGRFTISRDNSKNTLYLQMNSLRAEDTAVYYCAKDRAYGDYVGWNGFDYWGQGTLVTVSS

SEQ ID NO: 932 - protein, 108 aa, Artificial Sequence; identical to SEQ ID NO: 10
  Description of Artificial Sequence: Synthetic polypeptide

SEQ ID NO: 933 - protein, 124 aa, Artificial Sequence
  Description of Artificial Sequence: Synthetic polypeptide
EVQLLESGGGLVQPGGSLRLSCAASGFTFSQYDMWWVRQAPGKGLEWVSVIYPSGGYTDYADSVKGRFTISRDNSKNTLYLQMNSLRAEDTAVYYCAKDRAYGDYVGWNGFDYWGQGTLVTVSS

SEQ ID NO: 934 - protein, 108 aa, Artificial Sequence; identical to SEQ ID NO: 10
  Description of Artificial Sequence: Synthetic polypeptide

SEQ ID NO: 935 - protein, 123 aa, Artificial Sequence
  Description of Artificial Sequence: Synthetic polypeptide
EVQLLESGGGLVQPGGSLRLSCAASGFTFSQYDMWWVRQAPGKGLEWVSVIYPSGTTFYADSVKGRFTISRDNSKNTLYLQMNSLRAEDTAVYYCAKDRAYGDYVGWNGFDYWGQGTLVTVSS

SEQ ID NO: 936 - protein, 108 aa, Artificial Sequence; identical to SEQ ID NO: 10
  Description of Artificial Sequence: Synthetic polypeptide

SEQ ID NO: 937 - protein, 124 aa, Artificial Sequence
  Description of Artificial Sequence: Synthetic polypeptide
EVQLLESGGGLVQPGGSLRLSCAASGFTFSQYDMWWVRQAPGKGLEWVSYIVPSGGFTDYADSVKGRFTISRDNSKNTLYLQMNSLRAEDTAVYYCAKDRAYGDYVGWNGFDYWGQGTLVTVSS

SEQ ID NO: 938 - protein, 108 aa, Artificial Sequence; identical to SEQ ID NO: 10
  Description of Artificial Sequence: Synthetic polypeptide

SEQ ID NO: 939 - protein, 124 aa, Artificial Sequence
  Description of Artificial Sequence: Synthetic polypeptide
EVQLLESGGGLVQPGGSLRLSCAASGFTFSQYGMWWVRQAPGKGLEWVSYIYPSGGGTYYADSVKGRFTISRDNSKNTLYLQMNSLRAEDTAVYYCAKDRAYGDYVGWNGFDYWGQGTLVTVSS

SEQ ID NO: 940 - protein, 108 aa, Artificial Sequence; identical to SEQ ID NO: 10
  Description of Artificial Sequence: Synthetic polypeptide

SEQ ID NO: 941 - protein, 124 aa, Artificial Sequence
  Description of Artificial Sequence: Synthetic polypeptide
EVQLLESGGGLVQPGGSLRLSCAASGFTFSQYMMIWVRQAPGKGLEWVSYIVPSGGTTGYADSVKGRFTISRDNSKNTLYLQMNSLRAEDTAVYYCAKDRAYGDYVGWNGFDYWGQGTLVTVSS

SEQ ID NO: 942 - protein, 108 aa, Artificial Sequence; identical to SEQ ID NO: 10
  Description of Artificial Sequence: Synthetic polypeptide

SEQ ID NO: 943 - protein, 124 aa, Artificial Sequence
  Description of Artificial Sequence: Synthetic polypeptide
EVQLLESGGGLVQPGGSLRLSCAASGFTFSQYPMFWVRQAPGKGLEWVSYIVPSGGYTSYADSVKGRFTISRDNSKNTLYLQMNSLRAEDTAVYYCAKDRAYGDYVGWNGFDYWGQGTLVTVSS

SEQ ID NO: 944 - protein, 108 aa, Artificial Sequence; identical to SEQ ID NO: 10
  Description of Artificial Sequence: Synthetic polypeptide

SEQ ID NO: 945 - protein, 124 aa, Artificial Sequence
  Description of Artificial Sequence: Synthetic polypeptide
EVQLLESGGGLVQPGGSLRLSCAASGFTFSQYPMIWVRQAPGKGLEWVSYIVPSGGWTSYADSVKGRFTISRDNSKNTLYLQMNSLRAEDTAVYYCAKDRAYGDYVGWNGFDYWGQGTLVTVSS

SEQ ID NO: 946 - protein, 108 aa, Artificial Sequence; identical to SEQ ID NO: 10
  Description of Artificial Sequence: Synthetic polypeptide

SEQ ID NO: 947 - protein, 124 aa, Artificial Sequence
  Description of Artificial Sequence: Synthetic polypeptide
EVQLLESGGGLVQPGGSLRLSCAASGFTFSQYPMMWVRQAPGKGLEWVSYIYPSGGATYYADSVKGRFTISRDNSKNTLYLQMNSLRAEDTAVYYCAKDRAYGDYVGWNGFDYWGQGTLVTVSS

SEQ ID NO: 948 - protein, 108 aa, Artificial Sequence; identical to SEQ ID NO: 10
  Description of Artificial Sequence: Synthetic polypeptide

SEQ ID NO: 949 - protein, 124 aa, Artificial Sequence
  Description of Artificial Sequence: Synthetic polypeptide
EVQLLESGGGLVQPGGSLRLSCAASGFTFSQYPMMWVRQAPGKGLEWVSYIYPSGGGTYYADSVKGRFTISRDNSKNTLYLQMNSLRAEDTAVYYCAKDRAYGDYVGWNGFDYWGQGTLVTVSS

SEQ ID NO: 950 - protein, 108 aa, Artificial Sequence; identical to SEQ ID NO: 10
  Description of Artificial Sequence: Synthetic polypeptide

SEQ ID NO: 951 - protein, 124 aa, Artificial Sequence
  Description of Artificial Sequence: Synthetic polypeptide
EVQLLESGGGLVQPGGSLRLSCAASGFTFSQYPMWWVRQAPGKGLEWVSSISPSGGATYYADSVKGRFTISRDNSKNTLYLQMNSLRAEDTAVYYCAKDRAYGDYVGWNGFDYWGQGTLVTVSS

SEQ ID NO: 952 - protein, 108 aa, Artificial Sequence; identical to SEQ ID NO: 10
  Description of Artificial Sequence: Synthetic polypeptide

SEQ ID NO: 953 - protein, 124 aa, Artificial Sequence
  Description of Artificial Sequence: Synthetic polypeptide
EVQLLESGGGLVQPGGSLRLSCAASGFTFSQYPMWWVRQAPGKGLEWVSSIYPSGGGTFYADSVKGRFTISRDNSKNTLYLQMNSLRAEDTAVYYCAKDRAYGDYVGWNGFDYWGQGTLVTVSS

SEQ ID NO: 954 - protein, 108 aa, Artificial Sequence; identical to SEQ ID NO: 10
  Description of Artificial Sequence: Synthetic polypeptide

SEQ ID NO: 955 - protein, 124 aa, Artificial Sequence
  Description of Artificial Sequence: Synthetic polypeptide
EVQLLESGGGLVQPGGSLRLSCAASGFTFSQYPMWWVRQAPGKGLEWVSSIYSSGGATYYADSVKGRFTISRDNSKNTLYLQMNSLRAEDTAVYYCAKDRAYGDYVGWNGFDYWGQGTLVTVSS

SEQ ID NO: 956 - protein, 108 aa, Artificial Sequence; identical to SEQ ID NO: 10
  Description of Artificial Sequence: Synthetic polypeptide

SEQ ID NO: 957 - protein, 124 aa, Artificial Sequence
  Description of Artificial Sequence: Synthetic polypeptide
EVQLLESGGGLVQPGGSLRLSCAASGFTFSQYPMWWVRQAPGKGLEWVSVIYPSGGFTSYADSVKGRFTISRDNSKNTLYLQMNSLRAEDTAVYYCAKDRAYGDYVGWNGFDYWGQGTLVTVSS

SEQ ID NO: 958 - protein, 108 aa, Artificial Sequence; identical to SEQ ID NO: 10
  Description of Artificial Sequence: Synthetic polypeptide

SEQ ID NO: 959 - protein, 124 aa, Artificial Sequence
  Description of Artificial Sequence: Synthetic polypeptide
EVQLLESGGGLVQPGGSLRLSCAASGFTFSQYPMWWVRQAPGKGLEWVSVIYPSGGYTGYADSVKGRFTISRDNSKNTLYLQMNSLRAEDTAVYYCAKDRAYGDYVGWNGFDYWGQGTLVTVSS

SEQ ID NO: 960 - protein, 108 aa, Artificial Sequence; identical to SEQ ID NO: 10
  Description of Artificial Sequence: Synthetic polypeptide

SEQ ID NO: 961 - protein, 124 aa, Artificial Sequence
  Description of Artificial Sequence: Synthetic polypeptide
EVQLLESGGGLVQPGGSLRLSCAASGFTFSQYQMWWVRQAPGKGLEWVSVIYPSGGATYYADSVKGRFTISRDNSKNTLYLQMNSLRAEDTAVYYCAKDRAYGDYVGWNGFDYWGQGTLVTVSS

SEQ ID NO: 962 - protein, 108 aa, Artificial Sequence; identical to SEQ ID NO: 10
  Description of Artificial Sequence: Synthetic polypeptide

SEQ ID NO: 963 - protein, 124 aa, Artificial Sequence
  Description of Artificial Sequence: Synthetic polypeptide
EVQLLESGGGLVQPGGSLRLSCAASGFTFSQYSMIWVRQAPGKGLEWVSYIVPSGGYTSYADSVKGRFTISRDNSKNTLYLQMNSLRAEDTAVYYCAKDRAYGDYVGWNGFDYWGQGTLVTVSS

SEQ ID NO: 964 - protein, 108 aa, Artificial Sequence; identical to SEQ ID NO: 10
  Description of Artificial Sequence: Synthetic polypeptide

SEQ ID NO: 965 - protein, 124 aa, Artificial Sequence
  Description of Artificial Sequence: Synthetic polypeptide
EVQLLESGGGLVQPGGSLRLSCAASGFTFSQYSMWWVRQAPGKGLEWVSSIVPSGGATFYADSVKGRFTISRDNSKNTLYLQMNSLRAEDTAVYYCAKDRAYGDYVGWNGFDYWGQGTLVTVSS

SEQ ID NO: 966 - protein, 108 aa, Artificial Sequence; identical to SEQ ID NO: 10
  Description of Artificial Sequence: Synthetic polypeptide

SEQ ID NO: 967 - protein, 124 aa, Artificial Sequence
  Description of Artificial Sequence: Synthetic polypeptide
EVQLLESGGGLVQPGGSLRLSCAASGFTFSQYSMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 968 - protein, 108 aa, Artificial Sequence; identical to SEQ ID NO: 10
  Description of Artificial Sequence: Synthetic polypeptide

SEQ ID NO: 969 - protein, 124 aa, Artificial Sequence
  Description of Artificial Sequence: Synthetic polypeptide
EVQLLESGGGLVQPGGSLRLSCAASGFTFSQYSMWWVRQAPGKGLEWVSVIYSSGSATFYADSVKGRFTISRDNSKNTLYLQMNSLRAEDTAVYYCAKDRAYGDYVGWNGFDYWGQGTLVTVSS

SEQ ID NO: 970 - protein, 108 aa, Artificial Sequence; identical to SEQ ID NO: 10
  Description of Artificial Sequence: Synthetic polypeptide

SEQ ID NO: 971 - protein, 124 aa, Artificial Sequence
  Description of Artificial Sequence: Synthetic polypeptide
EVQLLESGGGLVQPGGSLRLSCAASGFTFSQYWMWWVRQAPGKGLEWVSVISSSGGGTYYADSVKGRFTISRDNSKNTLYLQMNSLRAEDTAVYYCAKDRAYGDYVGWNGFDYWGQGTLVTVSS

SEQ ID NO: 972 - protein, 108 aa, Artificial Sequence; identical to SEQ ID NO: 10
  Description of Artificial Sequence: Synthetic polypeptide

SEQ ID NO: 973 - protein, 124 aa, Artificial Sequence
  Description of Artificial Sequence: Synthetic polypeptide
EVQLLESGGGLVQPGGSLRLSCAASGFTFSQYWMWWVRQAPGKGLEWVSVIVPSGGKTFYADSVKGRFTISRDNSKNTLYLQMNSLRAEDTAVYYCAKDRAYGDYVGWNGFDYWGQGTLVTVSS

SEQ ID NO: 974 - protein, 108 aa, Artificial Sequence; identical to SEQ ID NO: 10
  Description of Artificial Sequence: Synthetic polypeptide

SEQ ID NO: 975 - protein, 124 aa, Artificial Sequence
  Description of Artificial Sequence: Synthetic polypeptide
EVQLLESGGGLVQPGGSLRLSCAASGFTFSRYAMIWVRQAPGKGLEWVSYISPSGGFTDYADSVKGRFTISRDNSKNTLYLQMNSLRAEDTAVYYCAKDRAYGDYVGWNGFDYWGQGTLVTVSS

SEQ ID NO: 976 - protein, 108 aa, Artificial Sequence; identical to SEQ ID NO: 10
  Description of Artificial Sequence: Synthetic polypeptide

SEQ ID NO: 977 - protein, 124 aa, Artificial Sequence
  Description of Artificial Sequence: Synthetic polypeptide
EVQLLESGGGLVQPGGSLRLSCAASGFTFSRYAMMWVRQAPGKGLEWVSYISPSGGFTDYADSVKGRFTISRDNSKNTLYLQMNSLRAEDTAVYYCAKDRAYGDYVGWNGFDYWGQGTLVTVSS

SEQ ID NO: 978 - protein, 108 aa, Artificial Sequence; identical to SEQ ID NO: 10
  Description of Artificial Sequence: Synthetic polypeptide

SEQ ID NO: 979 - protein, 124 aa, Artificial Sequence
  Description of Artificial Sequence: Synthetic polypeptide
EVQLLESGGGLVQPGGSLRLSCAASGFTFSRYAMWWVRQAPGKGLEWVSSIYPSGGGTFYADSVKGRFTISRDNSKNTLYLQMNSLRAEDTAVYYCAKDRAYGDYVGWNGFDYWGQGTLVTVSS

SEQ ID NO: 980 - protein, 108 aa, Artificial Sequence; identical to SEQ ID NO: 10
  Description of Artificial Sequence: Synthetic polypeptide

SEQ ID NO: 981 - protein, 124 aa, Artificial Sequence
  Description of Artificial Sequence: Synthetic polypeptide
EVQLLESGGGLVQPGGSLRLSCAASGFTFSRYAMWWVRQAPGKGLEWVSYIVPSGGYTDYADSVKGRFTISRDNSKNTLYLQMNSLRAEDTAVYYCAKDRAYGDYVGWNGFDYWGQGTLVTVSS

SEQ ID NO: 982 - protein, 108 aa, Artificial Sequence; identical to SEQ ID NO: 10
  Description of Artificial Sequence: Synthetic polypeptide

SEQ ID NO: 983 - protein, 124 aa, Artificial Sequence
  Description of Artificial Sequence: Synthetic polypeptide
EVQLLESGGGLVQPGGSLRLSCAASGFTFSRYDMFWVRQAPGKGLEWVSSISPSGGGTYYADSVKGRFTISRDNSKNTLYLQMNSLRAEDTAVYYCAKDRAYGDYVGWNGFDYWGQGTLVTVSS

SEQ ID NO: 984 - protein, 108 aa, Artificial Sequence; identical to SEQ ID NO: 10
  Description of Artificial Sequence: Synthetic polypeptide

SEQ ID NO: 985 - protein, 124 aa, Artificial Sequence
  Description of Artificial Sequence: Synthetic polypeptide
EVQLLESGGGLVQPGGSLRLSCAASGFTFSRYDMWWVRQAPGKGLEWVSSISSSGGFTGYADSVKGRFTISRDNSKNTLYLQMNSLRAEDTAVYYCAKDRAYGDYVGWNGFDYWGQGTLVTVSS

SEQ ID NO: 986 - protein, 108 aa, Artificial Sequence; identical to SEQ ID NO: 10
  Description of Artificial Sequence: Synthetic polypeptide

SEQ ID NO: 987 - protein, 124 aa, Artificial Sequence
  Description of Artificial Sequence: Synthetic polypeptide
EVQLLESGGGLVQPGGSLRLSCAASGFTFSRYDMWWVRQAPGKGLEWVSVISPSGGATFYADSVKGRFTISRDNSKNTLYLQMNSLRAEDTAVYYCAKDRAYGDYVGWNGFDYWGQGTLVTVSS

SEQ ID NO: 988 - protein, 108 aa, Artificial Sequence; identical to SEQ ID NO: 10
  Description of Artificial Sequence: Synthetic polypeptide

SEQ ID NO: 989 - protein, 124 aa, Artificial Sequence
  Description of Artificial Sequence: Synthetic polypeptide
EVQLLESGGGLVQPGGSLRLSCAASGFTFSRYDMWWVRQAPGKGLEWVSVIYPSGGHTMYADSVKGRFTISRDNSKNTLYLQMNSLRAEDTAVYYCAKDRAYGDYVGWNGFDYWGQGTLVTVSS

SEQ ID NO: 990 - protein, 108 aa, Artificial Sequence; identical to SEQ ID NO: 10
  Description of Artificial Sequence: Synthetic polypeptide

SEQ ID NO: 991 - protein, 124 aa, Artificial Sequence
  Description of Artificial Sequence: Synthetic polypeptide
EVQLLESGGGLVQPGGSLRLSCAASGFTFSRYDMWWVRQAPGKGLEWVSWISPSGGGTQYADSVKGRFTISRDNSKNTLYLQMNSLRAEDTAVYYCAKDRAYGDYVGWNGFDYWGQGTLVTVSS

SEQ ID NO: 992 - protein, 108 aa, Artificial Sequence; identical to SEQ ID NO: 10
  Description of Artificial Sequence: Synthetic polypeptide

SEQ ID NO: 993 - protein, 124 aa, Artificial Sequence
  Description of Artificial Sequence: Synthetic polypeptide
EVQLLESGGGLVQPGGSLRLSCAASGFTFSRYDMWWVRQAPGKGLEWVSYIVPSGGFTSYADSVKGRFTISRDNSKNTLYLQMNSLRAEDTAVYYCAKDRAYGDYVGWNGFDYWGQGTLVTVSS

SEQ ID NO: 994 - protein, 108 aa, Artificial Sequence; identical to SEQ ID NO: 10
  Description of Artificial Sequence: Synthetic polypeptide

SEQ ID NO: 995 - protein, 124 aa, Artificial Sequence
  Description of Artificial Sequence: Synthetic polypeptide
EVQLLESGGGLVQPGGSLRLSCAASGFTFSRYHMWWVRQAPGKGLEWVSYISPSGGSTLYADSVKGRFTISRDNSKNTLYLQMNSLRAEDTAVYYCAKDRAYGDYVGWNGFDYWGQGTLVTVSS

SEQ ID NO: 996 - protein, 108 aa, Artificial Sequence; identical to SEQ ID NO: 10
  Description of Artificial Sequence: Synthetic polypeptide

SEQ ID NO: 997 - protein, 124 aa, Artificial Sequence
  Description of Artificial Sequence: Synthetic polypeptide
EVQLLESGGGLVQPGGSLRLSCAASGFTFSRYMMIWVRQAPGKGLEWVSGIYPSGGWTDYADSVKGRFTISRDNSKNTLYLQMNSLRAEDTAVYYCAKDRAYGDYVGWNGFDYWGQGTLVTVSS

SEQ ID NO: 998 - protein, 108 aa, Artificial Sequence; identical to SEQ ID NO: 10
  Description of Artificial Sequence: Synthetic polypeptide

SEQ ID NO: 999 - protein, 124 aa, Artificial Sequence
  Description of Artificial Sequence: Synthetic polypeptide
EVQLLESGGGLVQPGGSLRLSCAASGFTFSRYNMWWVRQAPGKGLEWVSVIYPSGGATYYADSVKGRFTISRDNSKNTLYLQMNSLRAEDTAVYYCAKDRAYGDYVGWNGFDYWGQGTLVTVSS

SEQ ID NO: 1000 - protein, 108 aa, Artificial Sequence; identical to SEQ ID NO: 10
  Description of Artificial Sequence: Synthetic polypeptide

SEQ ID NO: 1001 - protein, 124 aa, Artificial Sequence
  Description of Artificial Sequence: Synthetic polypeptide
EVQLLESGGGLVQPGGSLRLSCAASGFTFSRYPMFWVRQAPGKGLEWVSYISPSGGYTSYADSVKGRFTISRDNSKNTLYLQMNSLRAEDTAVYYCAKDRAYGDYVGWNGFDYWGQGTLVTVSS

SEQ ID NO: 1002 - protein, 108 aa, Artificial Sequence; identical to SEQ ID NO: 10
  Description of Artificial Sequence: Synthetic polypeptide

SEQ ID NO: 1003 - protein, 124 aa, Artificial Sequence
  Description of Artificial Sequence: Synthetic polypeptide
EVQLLESGGGLVQPGGSLRLSCAASGFTFSRYPMFWVRQAPGKGLEWVSYIVPSGGYTDYADSVKGRFTISRDNSKNTLYLQMNSLRAEDTAVYYCAKDRAYGDYVGWNGFDYWGQGTLVTVSS

SEQ ID NO: 1004 - protein, 108 aa, Artificial Sequence; identical to SEQ ID NO: 10
  Description of Artificial Sequence: Synthetic polypeptide

SEQ ID NO: 1005 - protein, 124 aa, Artificial Sequence
  Description of Artificial Sequence: Synthetic polypeptide
EVQLLESGGGLVQPGGSLRLSCAASGFTFSRYPMIWVRQAPGKGLEWVSYIYPSGGGTYYADSVKGRFTISRDNSKNTLYLQMNSLRAEDTAVYYCAKDRAYGDYVGWNGFDYWGQGTLVTVSS

SEQ ID NO: 1006 - protein, 108 aa, Artificial Sequence; identical to SEQ ID NO: 10
  Description of Artificial Sequence: Synthetic polypeptide

SEQ ID NO: 1007 - protein, 124 aa, Artificial Sequence
  Description of Artificial Sequence: Synthetic polypeptide
EVQLLESGGGLVQPGGSLRLSCAASGFTFSRYPMVWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 1008 - protein, 108 aa, Artificial Sequence; identical to SEQ ID NO: 10
  Description of Artificial Sequence: Synthetic polypeptide

SEQ ID NO: 1009 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSSISSSGGGTYYADSVKGRFTISRDNSKNTLYLQMNSLRAEDTAVYYCAKDRAYGDYVGWNGFDYWGQGTLVTVSS

SEQ ID NO: 1010 - protein, 108 aa, Artificial Sequence; identical to SEQ ID NO: 10
  Description of Artificial Sequence: Synthetic polypeptide

SEQ ID NO: 1011 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 1012 - protein, 108 aa, Artificial Sequence; identical to SEQ ID NO: 10
  Description of Artificial Sequence: Synthetic polypeptide

SEQ ID NO: 1013 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSVIYPSGGATYYADSVKGRFTISRDNSKNTLYLQMNSLRAEDTAVYYCAKDRAYGDYVGWNGFDYWGQGTLVTVSS

SEQ ID NO: 1014 - protein, 108 aa, Artificial Sequence; identical to SEQ ID NO: 10
  Description of Artificial Sequence: Synthetic polypeptide

SEQ ID NO: 1015 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSVIYPSGGTTFYADSVKGRFTISRDNSKNTLYLQMNSLRAEDTAVYYCAKDRAYGDYVGWNGFDYWGQGTLVTVSS

SEQ ID NO: 1016 - protein, 108 aa, Artificial Sequence; identical to SEQ ID NO: 10
  Description of Artificial Sequence: Synthetic polypeptide

SEQ ID NO: 1017 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSVIYSSGGYTGYADSVKGRFTISRDNSKNTLYLQMNSLRAEDTAVYYCAKDRAYGDYVGWNGFDYWGQGTLVTVSS

SEQ ID NO: 1018 - protein, 108 aa, Artificial Sequence; identical to SEQ ID NO: 10
  Description of Artificial Sequence: Synthetic polypeptide

SEQ ID NO: 1019 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYIGSSGGGTFYADSVKGRFTISRDNSKNTLYLQMNSLRAEDTAVYYCAKDRAYGDYVGWNGFDYWGQGTLVTVSS

SEQ ID NO: 1020 - protein, 108 aa, Artificial Sequence; identical to SEQ ID NO: 10
  Description of Artificial Sequence: Synthetic polypeptide

SEQ ID NO: 1021 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYISPSGGGTLYADSVKGRFTISRDNSKNTLYLQMNSLRAEDTAVYYCAKDRAYGDYVGWNGFDYWGQGTLVTVSS

SEQ ID NO: 1022 - protein, 108 aa, Artificial Sequence; identical to SEQ ID NO: 10
  Description of Artificial Sequence: Synthetic polypeptide

SEQ ID NO: 1023 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYISPSGGMTSYADSVKGRFTISRDNSKNTLYLQMNSLRAEDTAVYYCAKDRAYGDYVGWNGFDYWGQGTLVTVSS

SEQ ID NO: 1024 - protein, 108 aa, Artificial Sequence; identical to SEQ ID NO: 10
  Description of Artificial Sequence: Synthetic polypeptide

SEQ ID NO: 1025 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 1026 - protein, 108 aa, Artificial Sequence; identical to SEQ ID NO: 10
  Description of Artificial Sequence: Synthetic polypeptide

SEQ ID NO: 1027 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYISSSGGGTLYADSVKGRFTISRDNSKNTLYLQMNSLRAEDTAVYYCAKDRAYGDYVGWNGFDYWGQGTLVTVSS

SEQ ID NO: 1028 - protein, 108 aa, Artificial Sequence; identical to SEQ ID NO: 10
  Description of Artificial Sequence: Synthetic polypeptide

SEQ ID NO: 1029 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYIVPSGGATYYADSVKGRFTISRDNSKNTLYLQMNSLRAEDTAVYYCAKDRAYGDYVGWNGFDYWGQGTLVTVSS

SEQ ID NO: 1030 - protein, 108 aa, Artificial Sequence; identical to SEQ ID NO: 10
  Description of Artificial Sequence: Synthetic polypeptide

SEQ ID NO: 1031 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYIVPSGGFTDYAHSVKGRFTISRDNSKNTLYLQMNSLRAEDTAVYYCAKDRAYGDYVGWNGFDYWGQGTLVTVSS

SEQ ID NO: 1032 - protein, 108 aa, Artificial Sequence; identical to SEQ ID NO: 10
  Description of Artificial Sequence: Synthetic polypeptide

SEQ ID NO: 1033 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYIVPSGGTTYYADSVKGRFTISRDNSKNTLYLQMNSLRAEDTAVYYCAKDRAYGDYVGWNGFDYWGQGTLVTVSS

SEQ ID NO: 1034 - protein, 108 aa, Artificial Sequence; identical to SEQ ID NO: 10
  Description of Artificial Sequence: Synthetic polypeptide

SEQ ID NO: 1035 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYIYPSGGATFYADSVKGRFTISRDNSKNTLYLQMNSLRAEDTAVYYCAKDRAYGDYVGWNGFDYWGQGTLVTVSS

SEQ ID NO: 1036 - protein, 108 aa, Artificial Sequence; identical to SEQ ID NO: 10
  Description of Artificial Sequence: Synthetic polypeptide

SEQ ID NO: 1037 - protein, 124 aa, Artificial Sequence
  Description of Artificial Sequence: Synthetic polypeptide
EVQLLESGGGLVQPGGSLRLSCAASGFTFSRYPMWWVRQAPGKGLEWVSYIYSSGGKTFYADSVKGRFTISRDNSKNTLYLQMNSLRAEDTAVYYCAKDRAYGDYVGWNGFDYWGQGTLVTVSS

SEQ ID NO: 1038 - protein, 108 aa, Artificial Sequence; identical to SEQ ID NO: 10
  Description of Artificial Sequence: Synthetic polypeptide

SEQ ID NO: 1039 - protein, 124 aa, Artificial Sequence
  Description of Artificial Sequence: Synthetic polypeptide
EVQLLESGGGLVQPGGSLRLSCAASGFTFSRYSMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 1040 - protein, 108 aa, Artificial Sequence; identical to SEQ ID NO: 10
  Description of Artificial Sequence: Synthetic polypeptide

SEQ ID NO: 1041 - protein, 124 aa, Artificial Sequence
  Description of Artificial Sequence: Synthetic polypeptide
EVQLLESGGGLVQPGGSLRLSCAASGFTFSRYSMWWVRQAPGKGLEWVSVIYPSGGYTGYADSVKGRFTISRDNSKNTLYLQMNSLRAEDTAVYYCAKDRAYGDYVGWNGFDYWGQGTLVTVSS

SEQ ID NO: 1042 - protein, 108 aa, Artificial Sequence; identical to SEQ ID NO: 10
  Description of Artificial Sequence: Synthetic polypeptide

SEQ ID NO: 1043 - protein, 124 aa, Artificial Sequence
  Description of Artificial Sequence: Synthetic polypeptide
EVQLLESGGGLVQPGGSLRLSCAASGFTFSRYWMWWVRQAPGKGLEWVSVIVPSGGATFYADSVKGRFTISRDNSKNTLYLQMNSLRAEDTAVYYCAKDRAYGDYVGWNGFDYWGQGTLVTVSS

SEQ ID NO: 1044 - protein, 108 aa, Artificial Sequence; identical to SEQ ID NO: 10
  Description of Artificial Sequence: Synthetic polypeptide

SEQ ID NO: 1045 - protein, 124 aa, Artificial Sequence
  Description of Artificial Sequence: Synthetic polypeptide
EVQLLESGGGLVQPGGSLRLSCAASGFTFSRYYMMWVRQAPGKGLEWVSYISPSGGATYYADSVKGRFTISRDNSKNTLYLQMNSLRAEDTAVYYCAKDRAYGDYVGWNGFDYWGQGTLVTVSS

SEQ ID NO: 1046 - protein, 108 aa, Artificial Sequence; identical to SEQ ID NO: 10
  Description of Artificial Sequence: Synthetic polypeptide

SEQ ID NO: 1047 - protein, 124 aa, Artificial Sequence
  Description of Artificial Sequence: Synthetic polypeptide
EVQLLESGGGLVQPGGSLRLSCAASGFTFSSYDMIWVRQAPGKGLEWVSWIGPSGGSTMYADSVKGRFTISRDNSKNTLYLQMNSLRAEDTAVYYCAKDRAYGDYVGWNGFDYWGQGTLVTVSS

SEQ ID NO: 1048 - protein, 108 aa, Artificial Sequence; identical to SEQ ID NO: 10
  Description of Artificial Sequence: Synthetic polypeptide

SEQ ID NO: 1049 - protein, 124 aa, Artificial Sequence
  Description of Artificial Sequence: Synthetic polypeptide
EVQLLESGGGLVQPGGSLRLSCAASGFTFSSYDMWWVRQAPGKGLEWVSSISSSVGATYYADSVKGRFTISRDNSKNTLYLQMNSLRAEDTAVYYCAKDRAYGDYVGWNGFDYWGQGTLVTVSS

SEQ ID NO: 1050 - protein, 108 aa, Artificial Sequence; identical to SEQ ID NO: 10
  Description of Artificial Sequence: Synthetic polypeptide

SEQ ID NO: 1051 - protein, 124 aa, Artificial Sequence
  Description of Artificial Sequence: Synthetic polypeptide
EVQLLESGGGLVQPGGSLRLSCAASGFTFSSYDMWWVRQAPGKGLEWVSVIGPSGGGTFYADSVKGRFTISRDNSKNTLYLQMNSLRAEDTAVYYCAKDRAYGDYVGWNGFDYWGQGTLVTVSS

SEQ ID NO: 1052 - protein, 108 aa, Artificial Sequence; identical to SEQ ID NO: 10
  Description of Artificial Sequence: Synthetic polypeptide

SEQ ID NO: 1053 - protein, 124 aa, Artificial Sequence
  Description of Artificial Sequence: Synthetic polypeptide
EVQLLESGGGLVQPGGSLRLSCAASGFTFSSYDMWWVRQAPGKGLEWVSVISPSGGYTGYADSVKGRFTISRDNSKNTLYLQMNSLRAEDTAVYYCAKDRAYGDYVGWNGFDYWGQGTLVTVSS

SEQ ID NO: 1054 - protein, 108 aa, Artificial Sequence; identical to SEQ ID NO: 10
  Description of Artificial Sequence: Synthetic polypeptide

SEQ ID NO: 1055 - protein, 124 aa, Artificial Sequence
  Description of Artificial Sequence: Synthetic polypeptide
EVQLLESGGGLVQPGGSLRLSCAASGFTFSSYDMWWVRQAPGKGLEWVSVIYPSGGRTYYADSVKGRFTISRDNSKNTLYLQMNSLRAEDTAVYYCAKDRAYGDYVGWNGFDYWGQGTLVTVSS

SEQ ID NO: 1056 - protein, 108 aa, Artificial Sequence; identical to SEQ ID NO: 10
  Description of Artificial Sequence: Synthetic polypeptide

SEQ ID NO: 1057 - protein, 124 aa, Artificial Sequence
  Description of Artificial Sequence: Synthetic polypeptide
EVQLLESGGGLVQPGGSLRLSCAASGFTFSSYDMWWVRQAPGKGLEWVSVIYSSGGFTGYADSVKGRFTISRDNSKNTLYLQMNSLRAEDTAVYYCAKDRAYGDYVGWNGFDYWGQGTLVTVSS

SEQ ID NO: 1058 - protein, 108 aa, Artificial Sequence; identical to SEQ ID NO: 10
  Description of Artificial Sequence: Synthetic polypeptide

SEQ ID NO: 1059 - protein, 124 aa, Artificial Sequence
  Description of Artificial Sequence: Synthetic polypeptide
EVQLLESGGGLVQPGGSLRLSCAASGFTFSSYDMWWVRQAPGKGLEWVSVIYSSGGTTFYADSVKGRFTISRDNSKNTLYLQMNSLRAEDTAVYYCAKDRAYGDYVGWNGFDYWGQGTLVTVSS

SEQ ID NO: 1060 - protein, 108 aa, Artificial Sequence; identical to SEQ ID NO: 10
  Description of Artificial Sequence: Synthetic polypeptide

SEQ ID NO: 1061 - protein, 124 aa, Artificial Sequence
  Description of Artificial Sequence: Synthetic polypeptide
EVQLLESGGGLVQPGGSLRLSCAASGFTFSSYDMWWVRQAPGKGLEWVSVIYSSGGYTGYADSVKGRFTISRDNSKNTLYLQMNSLRAEDTAVYYCAKDRAYGDYVGWNGFDYWGQGTLVTVSS

SEQ ID NO: 1062 - protein, 108 aa, Artificial Sequence; identical to SEQ ID NO: 10
  Description of Artificial Sequence: Synthetic polypeptide

SEQ ID NO: 1063 - protein, 124 aa, Artificial Sequence
  Description of Artificial Sequence: Synthetic polypeptide
EVQLLESGGGLVQPGGSLRLSCAASGFTFSSYEMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 1064 - protein, 108 aa, Artificial Sequence; identical to SEQ ID NO: 10
  Description of Artificial Sequence: Synthetic polypeptide

SEQ ID NO: 1065 - protein, 124 aa, Artificial Sequence
  Description of Artificial Sequence: Synthetic polypeptide
EVQLLESGGGLVQPGGSLRLSCAASGFTFSSYEMWWVRQAPGKGLEWVSYISSSGGGTYYADSVKGRFTISRDNSKNTLYLQMNSLRAEDTAVYYCAKDRAYGDYVGWNGFDYWGQGTLVTVSS

SEQ ID NO: 1066 - protein, 108 aa, Artificial Sequence; identical to SEQ ID NO: 10
  Description of Artificial Sequence: Synthetic polypeptide

SEQ ID NO: 1067 - protein, 124 aa, Artificial Sequence
  Description of Artificial Sequence: Synthetic polypeptide
EVQLLESGGGLVQPGGSLRLSCAASGFTFSSYMMIWVRQAPGKGLEWVSSISPSGGGTYYADSVKGRFTISRDNSKNTLYLQMNSLRAEDTAVYYCAKDRAYGDYVGWNGFDYWGQGTLVTVSS

SEQ ID NO: 1068 - protein, 108 aa, Artificial Sequence; identical to SEQ ID NO: 10
  Description of Artificial Sequence: Synthetic polypeptide

SEQ ID NO: 1069 - protein, 124 aa, Artificial Sequence
  Description of Artificial Sequence: Synthetic polypeptide
EVQLLESGGGLVQPGGSLRLSCAASGFTFSSYMMIWVRQAPGKGLEWVSSISPSGGWTSYADSVKGRFTISRDNSKNTLYLQMNSLRAEDTAVYYCAKDRAYGDYVGWNGFDYWGQGTLVTVSS

SEQ ID NO: 1070 - protein, 108 aa, Artificial Sequence; identical to SEQ ID NO: 10
  Description of Artificial Sequence: Synthetic polypeptide

SEQ ID NO: 1071 - protein, 124 aa, Artificial Sequence
  Description of Artificial Sequence: Synthetic polypeptide
EVQLLESGGGLVQPGGSLRLSCAASGFTFSSYMMIWVRQAPGKGLEWVSSIYPSGGYTSYADSVKGRFTISRDNSKNTLYLQMNSLRAEDTAVYYCAKDRAYGDYVGWNGFDYWGQGTLVTVSS

SEQ ID NO: 1072 - protein, 108 aa, Artificial Sequence; identical to SEQ ID NO: 10
  Description of Artificial Sequence: Synthetic polypeptide

SEQ ID NO: 1073 - protein, 124 aa, Artificial Sequence
  Description of Artificial Sequence: Synthetic polypeptide
EVQLLESGGGLVQPGGSLRLSCAASGFTFSSYNMWWVRQAPGKGLEWVSSISPSGGGTYYADSVKGRFTISRDNSKNTLYLQMNSLRAEDTAVYYCAKDRAYGDYVGWNGFDYWGQGTLVTVSS

SEQ ID NO: 1074 - protein, 108 aa, Artificial Sequence; identical to SEQ ID NO: 10
  Description of Artificial Sequence: Synthetic polypeptide

SEQ ID NO: 1075 - protein, 124 aa, Artificial Sequence
  Description of Artificial Sequence: Synthetic polypeptide
EVQLLESGGGLVQPGGSLRLSCAASGFTFSSYPMIWVRQAPGKGLEWVSYISSSGGFTDYADSVKGRFTISRDNSKNTLYLQMNSLRAEDTAVYYCAKDRAYGDYVGWNGFDYWGQGTLVTVSS

SEQ ID NO: 1076 - protein, 108 aa, Artificial Sequence; identical to SEQ ID NO: 10
  Description of Artificial Sequence: Synthetic polypeptide

SEQ ID NO: 1077 - protein, 124 aa, Artificial Sequence
  Description of Artificial Sequence: Synthetic polypeptide
EVQLLESGGGLVQPGGSLRLSCAASGFTFSSYPMMWVRQAPGKGLEWVSYIYSSGGGTFYADSVKGRFTISRDNSKNTLYLQMNSLRAEDTAVYYCAKDRAYGDYVGWNGFDYWGQGTLVTVSS

SEQ ID NO: 1078 - protein, 108 aa, Artificial Sequence; identical to SEQ ID NO: 10
  Description of Artificial Sequence: Synthetic polypeptide

SEQ ID NO: 1079 - protein, 124 aa, Artificial Sequence
  Description of Artificial Sequence: Synthetic polypeptide
EVQLLESGGGLVQPGGSLRLSCAASGFTFSSYPMWWVRQAPGKGLEWVSSISPSGGGTYYADSVKGRFTISRDNSKNTLYLQMNSLRAEDTAVYYCAKDRAYGDYVGWNGFDYWGQGTLVTVSS

SEQ ID NO: 1080 - protein, 108 aa, Artificial Sequence; identical to SEQ ID NO: 10
  Description of Artificial Sequence: Synthetic polypeptide

SEQ ID NO: 1081 - protein, 123 aa, Artificial Sequence
  Description of Artificial Sequence: Synthetic polypeptide
EVQLLESGGGLVQPGGSLRLSCAASGFTFSSYPMWWVRQAPGKGLEWVSSISPSGMTYYADSVKGRFTISRDNSKNTLYLQMNSLRAEDTAVYYCAKDRAYGDYVGWNGFDYWGQGTLVTVSS

SEQ ID NO: 1082 - protein, 108 aa, Artificial Sequence; identical to SEQ ID NO: 10
  Description of Artificial Sequence: Synthetic polypeptide

SEQ ID NO: 1083 - protein, 124 aa, Artificial Sequence
  Description of Artificial Sequence: Synthetic polypeptide
EVQLLESGGGLVQPGGSLRLSCAASGFTFSSYPMWWVRQAPGKGLEWVSSIYPSGGGTFYADSVKGRFTISRDNSKNTLYLQMNSLRAEDTAVYYCAKDRAYGDYVGWNGFDYWGQGTLVTVSS

SEQ ID NO: 1084 - protein, 108 aa, Artificial Sequence; identical to SEQ ID NO: 10
  Description of Artificial Sequence: Synthetic polypeptide

SEQ ID NO: 1085 - protein, 124 aa, Artificial Sequence
  Description of Artificial Sequence: Synthetic polypeptide
EVQLLESGGGLVQPGGSLRLSCAASGFTFSSYPMWWVRQAPGKGLEWVSYISSSGGGTYYADSVKGRFTISRDNSKNTLYLQMNSLRAEDTAVYYCAKDRAYGDYVGWNGFDYWGQGTLVTVSS

SEQ ID NO: 1086 - protein, 108 aa, Artificial Sequence; identical to SEQ ID NO: 10
  Description of Artificial Sequence: Synthetic polypeptide

SEQ ID NO: 1087 - protein, 124 aa, Artificial Sequence
  Description of Artificial Sequence: Synthetic polypeptide
EVQLLESGGGLVQPGGSLRLSCAASGFTFSSYPMWWVRQAPGKGLEWVSYIVPSGGATFYADSVKGRFTISRDNSKNTLYLQMNSLRAEDTAVYYCAKDRAYGDYVGWNGFDYWGQGTLVTVSS

SEQ ID NO: 1088 - protein, 108 aa, Artificial Sequence; identical to SEQ ID NO: 10
  Description of Artificial Sequence: Synthetic polypeptide

SEQ ID NO: 1089 - protein, 124 aa, Artificial Sequence
  Description of Artificial Sequence: Synthetic polypeptide
EVQLLESGGGLVQPGGSLRLSCAASGFTFSSYPMWWVRQAPGKGLEWVSYIVPSGGSTLYADSVKGRFTISRDNSKNTLYLQMNSLRAEDTAVYYCAKDRAYGDYVGWNGFDYWGQGTLVTVSS

SEQ ID NO: 1090 - protein, 108 aa, Artificial Sequence; identical to SEQ ID NO: 10
  Description of Artificial Sequence: Synthetic polypeptide

SEQ ID NO: 1091 - protein, 124 aa, Artificial Sequence
  Description of Artificial Sequence: Synthetic polypeptide
EVQLLESGGGLVQPGGSLRLSCAASGFTFSSYPMWWVRQAPGKGLEWVSYIVPSGGYTYYADSVKGRFTISRDNSKNTLYLQMNSLRAEDTAVYYCAKDRAYGDYVGWNGFDYWGQGTLVTVSS

SEQ ID NO: 1092 - protein, 108 aa, Artificial Sequence; identical to SEQ ID NO: 10
  Description of Artificial Sequence: Synthetic polypeptide

SEQ ID NO: 1093 - protein, 124 aa, Artificial Sequence
  Description of Artificial Sequence: Synthetic polypeptide
EVQLLESGGGLVQPGGSLRLSCAASGFTFSSYQMWWVRQAPGKGLEWVSSIYPSGGATFYADSVKGRFTISRDNSKNTLYLQMNSLRAEDTAVYYCAKDRAYGDYVGWNGFDYWGQGTLVTVSS

SEQ ID NO: 1094 - protein, 108 aa, Artificial Sequence; identical to SEQ ID NO: 10
  Description of Artificial Sequence: Synthetic polypeptide

SEQ ID NO: 1095 - protein, 124 aa, Artificial Sequence
  Description of Artificial Sequence: Synthetic polypeptide
EVQLLESGGGLVQPGGSLRLSCAASGFTFSSYSMWWVRQAPGKGLEWVSVIYSSGGYTGYADSVKGRFTISRDNSKNTLYLQMNSLRAEDTAVYYCAKDRAYGDYVGWNGFDYWGQGTLVTVSS

SEQ ID NO: 1096 - protein, 108 aa, Artificial Sequence; identical to SEQ ID NO: 10
  Description of Artificial Sequence: Synthetic polypeptide

SEQ ID NO: 1097 - protein, 124 aa, Artificial Sequence
  Description of Artificial Sequence: Synthetic polypeptide
EVQLLESGGGLVQPGGSLRLSCAASGFTFSTYAMIWVRQAPGKGLEWVSYIGPSGGFTDYADSVKGRFTISRDNSKNTLYLQMNSLRAEDTAVYYCAKDRAYGDYVGWNGFDYWGQGTLVTVSS

SEQ ID NO: 1098 - protein, 108 aa, Artificial Sequence; identical to SEQ ID NO: 10
  Description of Artificial Sequence: Synthetic polypeptide

SEQ ID NO: 1099 - protein, 124 aa, Artificial Sequence
  Description of Artificial Sequence: Synthetic polypeptide
EVQLLESGGGLVQPGGSLRLSCAASGFTFSTYAMWWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 1100 - protein, 108 aa, Artificial Sequence; identical to SEQ ID NO: 10
  Description of Artificial Sequence: Synthetic polypeptide

SEQ ID NO: 1101 - protein, 124 aa, Artificial Sequence
  Description of Artificial Sequence: Synthetic polypeptide
EVQLLESGGGLVQPGGSLRLSCAASGFTFSTYDMFWVRQAPGKGLEWVSSISSSGGATFYADSVKGRFTISRDNSKNTLYLQMNSLRAEDTAVYYCAKDRAYGDYVGWNGFDYWGQGTLVTVSS

SEQ ID NO: 1102 - protein, 108 aa, Artificial Sequence; identical to SEQ ID NO: 10
  Description of Artificial Sequence: Synthetic polypeptide

SEQ ID NO: 1103 - protein, 124 aa, Artificial Sequence
  Description of Artificial Sequence: Synthetic polypeptide
EVQLLESGGGLVQPGGSLRLSCAASGFTFSTYDMIWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 1104 - protein, 108 aa, Artificial Sequence; identical to SEQ ID NO: 10
  Description of Artificial Sequence: Synthetic polypeptide

SEQ ID NO: 1105 - protein, 124 aa, Artificial Sequence
  Description of Artificial Sequence: Synthetic polypeptide
EVQLLESGGGLVQPGGSLRLSCAASGFTFSTYDMIWVRQAPGKGLEWVSYISSSGGFTDYADSVKGRFTISRDNSKNTLYLQMNSLRAEDTAVYYCAKDRAYGDYVGWNGFDYWGQGTLVTVSS

SEQ ID NO: 1106 - protein, 108 aa, Artificial Sequence; identical to SEQ ID NO: 10
  Description of Artificial Sequence: Synthetic polypeptide

SEQ ID NO: 1107 - protein, 124 aa, Artificial Sequence
  Description of Artificial Sequence: Synthetic polypeptide
EVQLLESGGGLVQPGGSLRLSCAASGFTFSTYDMWWVRQAPGKGLEWVSVIYPSGGPTYYADSVKGRFTISRDNSKNTLYLQMNSLRAEDTAVYYCAKDRAYGDYVGWNGFDYWGQGTLVTVSS

SEQ ID NO: 1108 - protein, 108 aa, Artificial Sequence; identical to SEQ ID NO: 10
  Description of Artificial Sequence: Synthetic polypeptide

SEQ ID NO: 1109 - protein, 124 aa, Artificial Sequence
  Description of Artificial Sequence: Synthetic polypeptide
EVQLLESGGGLVQPGGSLRLSCAASGFTFSTYDMWWVRQAPGKGLEWVSYISSSGGGTFYADSVKGRFTISRDNSKNTLYLQMNSLRAEDTAVYYCAKDRAYGDYVGWNGFDYWGQGTLVTVSS

SEQ ID NO: 1110 - protein, 108 aa, Artificial Sequence; identical to SEQ ID NO: 10
  Description of Artificial Sequence: Synthetic polypeptide

SEQ ID NO: 1111 - protein, 124 aa, Artificial Sequence
  Description of Artificial Sequence: Synthetic polypeptide
EVQLLESGGGLVQPGGSLRLSCAASGFTFSTYEMWWVRQAPGKGLEWVSYISSSGGGTGYADSVKGRFTISRDNSKNTLYLQMNSLRAEDTAVYYCAKDRAYGDYVGWNGFDYWGQGTLVTVSS

SEQ ID NO: 1112 - protein, 108 aa, Artificial Sequence; identical to SEQ ID NO: 10
  Description of Artificial Sequence: Synthetic polypeptide

SEQ ID NO: 1113 - protein, 124 aa, Artificial Sequence
  Description of Artificial Sequence: Synthetic polypeptide
EVQLLESGGGLVQPGGSLRLSCAASGFTFSTYPMFWVRQAPGKGLEWVSYISPSGGYTDYADSVKGRFTISRDNSKNTLYLQMNSLRAEDTAVYYCAKDRAYGDYVGWNGFDYWGQGTLVTVSS

SEQ ID NO: 1114 - protein, 108 aa, Artificial Sequence; identical to SEQ ID NO: 10
  Description of Artificial Sequence: Synthetic polypeptide

SEQ ID NO: 1115 - protein, 124 aa, Artificial Sequence
  Description of Artificial Sequence: Synthetic polypeptide
EVQLLESGGGLVQPGGSLRLSCAASGFTFSTYPMIWVRQAPGKGLEWVSYIVPSGGYTGYADSVKGRFTISRDNSKNTLYLQMNSLRAEDTAVYYCAKDRAYGDYVGWNGFDYWGQGTLVTVSS

SEQ ID NO: 1116 - protein, 108 aa, Artificial Sequence; identical to SEQ ID NO: 10
  Description of Artificial Sequence: Synthetic polypeptide

SEQ ID NO: 1117 - protein, 124 aa, Artificial Sequence
  Description of Artificial Sequence: Synthetic polypeptide
EVQLLESGGGLVQPGGSLRLSCAASGFTFSTYPMMWVRQAPGKGLEWVSYIYPSGGATFYADSVKGRFTISRDNSKNTLYLQMNSLRAEDTAVYYCAKDRAYGDYVGWNGFDYWGQGTLVTVSS

SEQ ID NO: 1118 - protein, 108 aa, Artificial Sequence; identical to SEQ ID NO: 10
  Description of Artificial Sequence: Synthetic polypeptide

SEQ ID NO: 1119 - protein, 124 aa, Artificial Sequence
  Description of Artificial Sequence: Synthetic polypeptide
EVQLLESGGGLVQPGGSLRLSCAASGFTFSTYPMWWVRQAPGKGLEWVSSISPSGGATYYADSVKGRFTISRDNSKNTLYLQMNSLRAEDTAVYYCAKDRAYGDYVGWNGFDYWGQGTLVTVSS

SEQ ID NO: 1120 - protein, 108 aa, Artificial Sequence; identical to SEQ ID NO: 10
  Description of Artificial Sequence: Synthetic polypeptide

SEQ ID NO: 1121 - protein, 124 aa, Artificial Sequence
  Description of Artificial Sequence: Synthetic polypeptide
EVQLLESGGGLVQPGGSLRLSCAASGFTFSTYPMWWVRQAPGKGLEWVSSIVPSGGATYYADSVKGRFTISRDNSKNTLYLQMNSLRAEDTAVYYCAKDRAYGDYVGWNGFDYWGQGTLVTVSS

SEQ ID NO: 1122 - protein, 108 aa, Artificial Sequence; identical to SEQ ID NO: 10
  Description of Artificial Sequence: Synthetic polypeptide

SEQ ID NO: 1123 - protein, 124 aa, Artificial Sequence
  Description of Artificial Sequence: Synthetic polypeptide
EVQLLESGGGLVQPGGSLRLSCAASGFTFSTYPMWWVRQAPGKGLEWVSVIYSSGGYTGYADSVKGRFTISRDNSKNTLYLQMNSLRAEDTAVYYCAKDRAYGDYVGWNGFDYWGQGTLVTVSS

SEQ ID NO: 1124 - protein, 108 aa, Artificial Sequence; identical to SEQ ID NO: 10
  Description of Artificial Sequence: Synthetic polypeptide

SEQ ID NO: 1125 - protein, 124 aa, Artificial Sequence
  Description of Artificial Sequence: Synthetic polypeptide
EVQLLESGGGLVQPGGSLRLSCAASGFTFSTYPMWWVRQAPGKGLEWVSYISPSGGATFYADSVKGRFTISRDNSKNTLYLQMNSLRAEDTAVYYCAKDRAYGDYVGWNGFDYWGQGTLVTVSS

SEQ ID NO: 1126 - protein, 108 aa, Artificial Sequence; identical to SEQ ID NO: 10
  Description of Artificial Sequence: Synthetic polypeptide

SEQ ID NO: 1127 - protein, 124 aa, Artificial Sequence
  Description of Artificial Sequence: Synthetic polypeptide
EVQLLESGGGLVQPGGSLRLSCAASGFTFSTYPMWWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 1128 - protein, 108 aa, Artificial Sequence; identical to SEQ ID NO: 10
  Description of Artificial Sequence: Synthetic polypeptide

SEQ ID NO: 1129 - protein, 124 aa, Artificial Sequence
  Description of Artificial Sequence: Synthetic polypeptide
EVQLLESGGGLVQPGGSLRLSCAASGFTFSTYPMWWVRQAPGKGLEWVSYIVPSGGYTDYADSVKGRFTISRDNSKNTLYLQMNSLRAEDTAVYYCAKDRAYGDYVGWNGFDYWGQGTLVTVSS

SEQ ID NO: 1130 - protein, 108 aa, Artificial Sequence; identical to SEQ ID NO: 10
  Description of Artificial Sequence: Synthetic polypeptide

SEQ ID NO: 1131 - protein, 124 aa, Artificial Sequence
  Description of Artificial Sequence: Synthetic polypeptide
EVQLLESGGGLVQPGGSLRLSCAASGFTFSTYPMWWVRQAPGKGLEWVSYIYPSGGGTFYADSVKGRFTISRDNSKNTLYLQMNSLRAEDTAVYYCAKDRAYGDYVGWNGFDYWGQGTLVTVSS

SEQ ID NO: 1132 - protein, 108 aa, Artificial Sequence; identical to SEQ ID NO: 10
  Description of Artificial Sequence: Synthetic polypeptide

SEQ ID NO: 1133 - protein, 123 aa, Artificial Sequence
  Description of Artificial Sequence: Synthetic polypeptide
EVQLLESGGGLVQPGGSLRLSCAASGFTFSTYQMWWVRQAPGKGLEWVSSIYSSGGTFYADSVKGRFTISRDNSKNTLYLQMNSLRAEDTAVYYCAKDRAYGDYVGWNGFDYWGQGTLVTVSS

SEQ ID NO: 1134 - protein, 108 aa, Artificial Sequence; identical to SEQ ID NO: 10
  Description of Artificial Sequence: Synthetic polypeptide

SEQ ID NO: 1135 - protein, 124 aa, Artificial Sequence
  Description of Artificial Sequence: Synthetic polypeptide
EVQLLESGGGLVQPGGSLRLSCAASGFTFSTYSMIWVRQAPGKGLEWVSYISPSGGFTDYADSVKGRFTISRDNSKNTLYLQMNSLRAEDTAVYYCAKDRAYGDYVGWNGFDYWGQGTLVTVSS

SEQ ID NO: 1136 - protein, 108 aa, Artificial Sequence; identical to SEQ ID NO: 10
  Description of Artificial Sequence: Synthetic polypeptide

SEQ ID NO: 1137 - protein, 124 aa, Artificial Sequence
  Description of Artificial Sequence: Synthetic polypeptide
EVQLLESGGGLVQPGGSLRLSCAASGFTFSVYDMIWVRQAPGKGLEWVSYIGPSGGMTLYADSVKGRFTISRDNSKNTLYLQMNSLRAEDTAVYYCAKDRAYGDYVGWNGFDYWGQGTLVTVSS

SEQ ID NO: 1138 - protein, 108 aa, Artificial Sequence; identical to SEQ ID NO: 10
  Description of Artificial Sequence: Synthetic polypeptide

SEQ ID NO: 1139 - protein, 124 aa, Artificial Sequence
  Description of Artificial Sequence: Synthetic polypeptide
EVQLLESGGGLVQPGGSLRLSCAASGFTFSVYDMWWVRQAPGKGLEWVSVIYPSGGATYYADSVKGRFTISRDNSKNTLYLQMNSLRAEDTAVYYCAKDRAYGDYVGWNGFDYWGQGTLVTVSS

SEQ ID NO: 1140 - protein, 108 aa, Artificial Sequence; identical to SEQ ID NO: 10
  Description of Artificial Sequence: Synthetic polypeptide

SEQ ID NO: 1141 - protein, 124 aa, Artificial Sequence
  Description of Artificial Sequence: Synthetic polypeptide
EVQLLESGGGLVQPGGSLRLSCAASGFTFSVYDMWWVRQAPGKGLEWVSVIYPSGGYTDYADSVKGRFTISRDNSKNTLYLQMNSLRAEDTAVYYCAKDRAYGDYVGWNGFDYWGQGTLVTVSS

SEQ ID NO: 1142 - protein, 108 aa, Artificial Sequence; identical to SEQ ID NO: 10
  Description of Artificial Sequence: Synthetic polypeptide

SEQ ID NO: 1143 - protein, 124 aa, Artificial Sequence
  Description of Artificial Sequence: Synthetic polypeptide
EVQLLESGGGLVQPGGSLRLSCAASGFTFSVYDMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 1144 - protein, 108 aa, Artificial Sequence; identical to SEQ ID NO: 10
  Description of Artificial Sequence: Synthetic polypeptide

SEQ ID NO: 1145 - protein, 124 aa, Artificial Sequence
  Description of Artificial Sequence: Synthetic polypeptide
EVQLLESGGGLVQPGGSLRLSCAASGFTFSVYDMWWVRQAPGKGLEWVSVIYSSGGPTFYADSVKGRFTISRDNSKNTLYLQMNSLRAEDTAVYYCAKDRAYGDYVGWNGFDYWGQGTLVTVSS

SEQ ID NO: 1146 - protein, 108 aa, Artificial Sequence; identical to SEQ ID NO: 10
  Description of Artificial Sequence: Synthetic polypeptide

SEQ ID NO: 1147 - protein, 124 aa, Artificial Sequence
  Description of Artificial Sequence: Synthetic polypeptide
EVQLLESGGGLVQPGGSLRLSCAASGFTFSVYDMWWVRQAPGKGLEWVSYISPSGGFTDYADSVKGRFTISRDNSKNTLYLQMNSLRAEDTAVYYCAKDRAYGDYVGWNGFDYWGQGTLVTVSS

SEQ ID NO: 1148 - protein, 108 aa, Artificial Sequence; identical to SEQ ID NO: 10
  Description of Artificial Sequence: Synthetic polypeptide

SEQ ID NO: 1149 - protein, 124 aa, Artificial Sequence
  Description of Artificial Sequence: Synthetic polypeptide
EVQLLESGGGLVQPGGSLRLSCAASGFTFSVYEMWWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 1150 - protein, 108 aa, Artificial Sequence; identical to SEQ ID NO: 10
  Description of Artificial Sequence: Synthetic polypeptide

SEQ ID NO: 1151 - protein, 124 aa, Artificial Sequence
  Description of Artificial Sequence: Synthetic polypeptide
EVQLLESGGGLVQPGGSLRLSCAASGFTFSVYNMWWVRQAPGKGLEWVSSISPSGGGTFYADSVKGRFTISRDNSKNTLYLQMNSLRAEDTAVYYCAKDRAYGDYVGWNGFDYWGQGTLVTVSS

SEQ ID NO: 1152 - protein, 108 aa, Artificial Sequence; identical to SEQ ID NO: 10
  Description of Artificial Sequence: Synthetic polypeptide

SEQ ID NO: 1153 - protein, 124 aa, Artificial Sequence
  Description of Artificial Sequence: Synthetic polypeptide
EVQLLESGGGLVQPGGSLRLSCAASGFTFSVYPMWWVRQAPGKGLEWVSSISPSGGATYYADSVKGRFTISRDNSKNTLYLQMNSLRAEDTAVYYCAKDRAYGDYVGWNGFDYWGQGTLVTVSS

SEQ ID NO: 1154 - protein, 108 aa, Artificial Sequence; identical to SEQ ID NO: 10
  Description of Artificial Sequence: Synthetic polypeptide

SEQ ID NO: 1155 - protein, 124 aa, Artificial Sequence
  Description of Artificial Sequence: Synthetic polypeptide
EVQLLESGGGLVQPGGSLRLSCAASGFTFSVYPMWWVRQAPGKGLEWVSSISPSGGYTGYADSVKGRFTISRDNSKNTLYLQMNSLRAEDTAVYYCAKDRAYGDYVGWNGFDYWGQGTLVTVSS

SEQ ID NO: 1156 - protein, 108 aa, Artificial Sequence; identical to SEQ ID NO: 10
  Description of Artificial Sequence: Synthetic polypeptide

SEQ ID NO: 1157 - protein, 123 aa, Artificial Sequence
  Description of Artificial Sequence: Synthetic polypeptide
EVQLLESGGGLVQPGGSLRLSCAASGFTFSVYPMWWVRQAPGKGLEWVSSISSGGATYYADSVKGRFTISRDNSKNTLYLQMNSLRAEDTAVYYCAKDRAYGDYVGWNGFDYWGQGTLVTVSS

SEQ ID NO: 1158 - protein, 108 aa, Artificial Sequence; identical to SEQ ID NO: 10
  Description of Artificial Sequence: Synthetic polypeptide

SEQ ID NO: 1159 - protein, 124 aa, Artificial Sequence
  Description of Artificial Sequence: Synthetic polypeptide
EVQLLESGGGLVQPGGSLRLSCAASGFTFSVYPMWWVRQAPGKGLEWVSWISPSGGGTFYADSVKGRFTISRDNSKNTLYLQMNSLRAEDTAVYYCAKDRAYGDYVGWNGFDYWGQGTLVTVSS

SEQ ID NO: 1160 - protein, 108 aa, Artificial Sequence; identical to SEQ ID NO: 10
  Description of Artificial Sequence: Synthetic polypeptide

SEQ ID NO: 1161 - protein, 124 aa, Artificial Sequence
  Description of Artificial Sequence: Synthetic polypeptide
EVQLLESGGGLVQPGGSLRLSCAASGFTFSVYPMWWVRQAPGKGLEWVSWISSSGGGTAYADSVKGRFTISRDNSKNTLYLQMNSLRAEDTAVYYCAKDRAYGDYVGWNGFDYWGQGTLVTVSS

SEQ ID NO: 1162 - protein, 108 aa, Artificial Sequence; identical to SEQ ID NO: 10
  Description of Artificial Sequence: Synthetic polypeptide

SEQ ID NO: 1163 - protein, 124 aa, Artificial Sequence
  Description of Artificial Sequence: Synthetic polypeptide
EVQLLESGGGLVQPGGSLRLSCAASGFTFSVYPMWWVRQAPGKGLEWVSYIVPSGGATYYADSVKGRFTISRDNSKNTLYLQMNSLRAEDTAVYYCAKDRAYGDYVGWNGFDYWGQGTLVTVSS

SEQ ID NO: 1164 - protein, 108 aa, Artificial Sequence; identical to SEQ ID NO: 10
  Description of Artificial Sequence: Synthetic polypeptide

SEQ ID NO: 1165 - protein, 124 aa, Artificial Sequence
  Description of Artificial Sequence: Synthetic polypeptide
EVQLLESGGGLVQPGGSLRLSCAASGFTFSVYPMWWVRQAPGKGLEWVSYIYPSGGATYYADSVKGRFTISRDNSKNTLYLQMNSLRAEDTAVYYCAKDRAYGDYVGWNGFDYWGQGTLVTVSS

SEQ ID NO: 1166 - protein, 108 aa, Artificial Sequence; identical to SEQ ID NO: 10
  Description of Artificial Sequence: Synthetic polypeptide

SEQ ID NO: 1167 - protein, 124 aa, Artificial Sequence
  Description of Artificial Sequence: Synthetic polypeptide
EVQLLESGGGLVQPGGSLRLSCAASGFTFSVYQMWWVRQAPGKGLEWVSVIYPSGGTTFYADSVKGRFTISRDNSKNTLYLQMNSLRAEDTAVYYCAKDRAYGDYVGWNGFDYWGQGTLVTVSS

SEQ ID NO: 1168 - protein, 108 aa, Artificial Sequence; identical to SEQ ID NO: 10
  Description of Artificial Sequence: Synthetic polypeptide

SEQ ID NO: 1169 - protein, 124 aa, Artificial Sequence
  Description of Artificial Sequence: Synthetic polypeptide
EVQLLESGGGLVQPGGSLRLSCAASGFTFSVYWMIWVRQAPGKGLEWVSYISPSGGGTFYADSVKGRFTISRDNSKNTLYLQMNSLRAEDTAVYYCAKDRAYGDYVGWNGFDYWGQGTLVTVSS

SEQ ID NO: 1170 - protein, 108 aa, Artificial Sequence; identical to SEQ ID NO: 10
  Description of Artificial Sequence: Synthetic polypeptide

SEQ ID NO: 1171 - protein, 124 aa, Artificial Sequence
  Description of Artificial Sequence: Synthetic polypeptide
EVQLLESGGGLVQPGGSLRLSCAASGFTFSWYAMWWVRQAPGKGLEWVSSISPSGGGTYYADSVKGRFTISRDNSKNTLYLQMNSLRAEDTAVYYCAKDRAYGDYVGWNGFDYWGQGTLVTVSS

SEQ ID NO: 1172 - protein, 108 aa, Artificial Sequence; identical to SEQ ID NO: 10
  Description of Artificial Sequence: Synthetic polypeptide

SEQ ID NO: 1173 - protein, 124 aa, Artificial Sequence
  Description of Artificial Sequence: Synthetic polypeptide
EVQLLESGGGLVQPGGSLRLSCAASGFTFSWYDMFWVRQAPGKGLEWVSSISPSGGATFYADSVKGRFTISRDNSKNTLYLQMNSLRAEDTAVYYCAKDRAYGDYVGWNGFDYWGQGTLVTVSS

SEQ ID NO: 1174 - protein, 108 aa, Artificial Sequence; identical to SEQ ID NO: 10
  Description of Artificial Sequence: Synthetic polypeptide

SEQ ID NO: 1175 - protein, 124 aa, Artificial Sequence
  Description of Artificial Sequence: Synthetic polypeptide
EVQLLESGGGLVQPGGSLRLSCAASGFTFSWYDMWWVRQAPGKGLEWVSVIYPSGGATYYADSVKGRFTISRDNSKNTLYLQMNSLRAEDTAVYYCAKDRAYGDYVGWNGFDYWGQGTLVTVSS

SEQ ID NO: 1176 - protein, 108 aa, Artificial Sequence; identical to SEQ ID NO: 10
  Description of Artificial Sequence: Synthetic polypeptide

SEQ ID NO: 1177 - protein, 124 aa, Artificial Sequence
  Description of Artificial Sequence: Synthetic polypeptide
EVQLLESGGGLVQPGGSLRLSCAASGFTFSWYDMWWVRQAPGKGLEWVSVIYPSGGFTDYADSVKGRFTISRDNSKNTLYLQMNSLRAEDTAVYYCAKDRAYGDYVGWNGFDYWGQGTLVTVSS

SEQ ID NO: 1178 - protein, 108 aa, Artificial Sequence; identical to SEQ ID NO: 10
  Description of Artificial Sequence: Synthetic polypeptide

SEQ ID NO: 1179 - protein, 124 aa, Artificial Sequence
  Description of Artificial Sequence: Synthetic polypeptide
EVQLLESGGGLVQPGGSLRLSCAASGFTFSWYDMWWVRQAPGKGLEWVSVIYPSGGYTGYADSVKGRFTISRDNSKNTLYLQMNSLRAEDTAVYYCAKDRAYGDYVGWNGFDYWGQGTLVTVSS

SEQ ID NO: 1180 - protein, 108 aa, Artificial Sequence; identical to SEQ ID NO: 10
  Description of Artificial Sequence: Synthetic polypeptide

SEQ ID NO: 1181 - protein, 124 aa, Artificial Sequence
  Description of Artificial Sequence: Synthetic polypeptide
EVQLLESGGGLVQPGGSLRLSCAASGFTFSWYDMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 1182 - protein, 108 aa, Artificial Sequence; identical to SEQ ID NO: 10
  Description of Artificial Sequence: Synthetic polypeptide

SEQ ID NO: 1183 - protein, 124 aa, Artificial Sequence
  Description of Artificial Sequence: Synthetic polypeptide
EVQLLESGGGLVQPGGSLRLSCAASGFTFSWYDMWWVRQAPGKGLEWVSVIYSSGGPTFYADSVKGRFTISRDNSKNTLYLQMNSLRAEDTAVYYCAKDRAYGDYVGWNGFDYWGQGTLVTVSS

SEQ ID NO: 1184 - protein, 108 aa, Artificial Sequence; identical to SEQ ID NO: 10
  Description of Artificial Sequence: Synthetic polypeptide

SEQ ID NO: 1185 - protein, 124 aa, Artificial Sequence
  Description of Artificial Sequence: Synthetic polypeptide
EVQLLESGGGLVQPGGSLRLSCAASGFTFSWYEMWWVRQAPGKGLEWVSWISPSGGGTQYADSVKGRFTISRDNSKNTLYLQMNSLRAEDTAVYYCAKDRAYGDYVGWNGFDYWGQGTLVTVSS

SEQ ID NO: 1186 - protein, 108 aa, Artificial Sequence; identical to SEQ ID NO: 10
  Description of Artificial Sequence: Synthetic polypeptide

SEQ ID NO: 1187 - protein, 124 aa, Artificial Sequence
  Description of Artificial Sequence: Synthetic polypeptide
EVQLLESGGGLVQPGGSLRLSCAASGFTFSWYEMWWVRQAPGKGLEWVSYISPSGGGTYYADSVKGRFTISRDNSKNTLYLQMNSLRAEDTAVYYCAKDRAYGDYVGWNGFDYWGQGTLVTVSS

SEQ ID NO: 1188 - protein, 108 aa, Artificial Sequence; identical to SEQ ID NO: 10
  Description of Artificial Sequence: Synthetic polypeptide

SEQ ID NO: 1189 - protein, 124 aa, Artificial Sequence
  Description of Artificial Sequence: Synthetic polypeptide
EVQLLESGGGLVQPGGSLRLSCAASGFTFSWYNMWWVRQAPGKGLEWVSVIYPSGGGTFYADSVKGRFTISRDNSKNTLYLQMNSLRAEDTAVYYCAKDRAYGDYVGWNGFDYWGQGTLVTVSS

SEQ ID NO: 1190 - protein, 108 aa, Artificial Sequence; identical to SEQ ID NO: 10
  Description of Artificial Sequence: Synthetic polypeptide

SEQ ID NO: 1191 - protein, 124 aa, Artificial Sequence
  Description of Artificial Sequence: Synthetic polypeptide
EVQLLESGGGLVQPGGSLRLSCAASGFTFSWYNMWWVRQAPGKGLEWVSYIVSSGGFTDYADSVKGRFTISRDNSKNTLYLQMNSLRAEDTAVYYCAKDRAYGDYVGWNGFDYWGQGTLVTVSS

SEQ ID NO: 1192 - protein, 108 aa, Artificial Sequence; identical to SEQ ID NO: 10
  Description of Artificial Sequence: Synthetic polypeptide

SEQ ID NO: 1193 - protein, 124 aa, Artificial Sequence
  Description of Artificial Sequence: Synthetic polypeptide
EVQLLESGGGLVQPGGSLRLSCAASGFTFSWYPMIWVRQAPGKGLEWVSYISSSGGYTSYADSVKGRFTISRDNSKNTLYLQMNSLRAEDTAVYYCAKDRAYGDYVGWNGFDYWGQGTLVTVSS

SEQ ID NO: 1194 - protein, 108 aa, Artificial Sequence; identical to SEQ ID NO: 10
  Description of Artificial Sequence: Synthetic polypeptide

SEQ ID NO: 1195 - protein, 124 aa, Artificial Sequence
  Description of Artificial Sequence: Synthetic polypeptide
EVQLLESGGGLVQPGGSLRLSCAASGFTFSWYPMTWVRQAPGKGLEWVSYISPSGGYTGYADSVKGRFTISRDNSKNTLYLQMNSLRAEDTAVYYCAKDRAYGDYVGWNGFDYWGQGTLVTVSS

SEQ ID NO: 1196 - protein, 108 aa, Artificial Sequence; identical to SEQ ID NO: 10
  Description of Artificial Sequence: Synthetic polypeptide

SEQ ID NO: 1197 - protein, 124 aa, Artificial Sequence
  Description of Artificial Sequence: Synthetic polypeptide
EVQLLESGGGLVQPGGSLRLSCAASGFTFSWYPMVWVRQAPGKGLEWVSYIYPSGGGTFYADSVKGRFTISRDNSKNTLYLQMNSLRAEDTAVYYCAKDRAYGDYVGWNGFDYWGQGTLVTVSS

SEQ ID NO: 1198 - protein, 108 aa, Artificial Sequence; identical to SEQ ID NO: 10
  Description of Artificial Sequence: Synthetic polypeptide

SEQ ID NO: 1199 - protein, 124 aa, Artificial Sequence
  Description of Artificial Sequence: Synthetic polypeptide
EVQLLESGGGLVQPGGSLRLSCAASGFTFSWYPMWWVRQAPGKGLEWVSSISPSGGATYYADSVKGRFTISRDNSKNTLYLQMNSLRAEDTAVYYCAKDRAYGDYVGWNGFDYWGQGTLVTVSS

SEQ ID NO: 1200 - protein, 108 aa, Artificial Sequence; identical to SEQ ID NO: 10
  Description of Artificial Sequence: Synthetic polypeptide

SEQ ID NO: 1201 - protein, 124 aa, Artificial Sequence
  Description of Artificial Sequence: Synthetic polypeptide
EVQLLESGGGLVQPGGSLRLSCAASGFTFSWYPMWWVRQAPGKGLEWVSSIVPSGGATYYADSVKGRFTISRDNSKNTLYLQMNSLRAEDTAVYYCAKDRAYGDYVGWNGFDYWGQGTLVTVSS

SEQ ID NO: 1202 - protein, 108 aa, Artificial Sequence; identical to SEQ ID NO: 10
  Description of Artificial Sequence: Synthetic polypeptide

SEQ ID NO: 1203 - protein, 124 aa, Artificial Sequence
  Description of Artificial Sequence: Synthetic polypeptide
EVQLLESGGGLVQPGGSLRLSCAASGFTFSWYPMWWVRQAPGKGLEWVSVIYPSGGYTSYADSVKGRFTISRDNSKNTLYLQMNSLRAEDTAVYYCAKDRAYGDYVGWNGFDYWGQGTLVTVSS

SEQ ID NO: 1204 - protein, 108 aa, Artificial Sequence; identical to SEQ ID NO: 10
  Description of Artificial Sequence: Synthetic polypeptide

SEQ ID NO: 1205 - protein, 124 aa, Artificial Sequence
  Description of Artificial Sequence: Synthetic polypeptide
EVQLLESGGGLVQPGGSLRLSCAASGFTFSWYPMWWVRQAPGKGLEWVSVIYSSGGATFYADSVKGRFTISRDNSKNTLYLQMNSLRAEDTAVYYCAKDRAYGDYVGWNGFDYWGQGTLVTVSS

SEQ ID NO: 1206 - protein, 108 aa, Artificial Sequence; identical to SEQ ID NO: 10
  Description of Artificial Sequence: Synthetic polypeptide

SEQ ID NO: 1207 - protein, 124 aa, Artificial Sequence
  Description of Artificial Sequence: Synthetic polypeptide
EVQLLESGGGLVQPGGSLRLSCAASGFTFSWYPMWWVRQAPGKGLEWVSVIYSSGGYTGYADSVKGRFTISRDNSKNTLYLQMNSLRAEDTAVYYCAKDRAYGDYVGWNGFDYWGQGTLVTVSS

SEQ ID NO: 1208 - protein, 108 aa, Artificial Sequence; identical to SEQ ID NO: 10
  Description of Artificial Sequence: Synthetic polypeptide

SEQ ID NO: 1209 - protein, 124 aa, Artificial Sequence
  Description of Artificial Sequence: Synthetic polypeptide
EVQLLESGGGLVQPGGSLRLSCAASGFTFSWYPMWWVRQAPGKGLEWVSYIVPSGGATFYADSVKGRFTISRDNSKNTLYLQMNSLRAEDTAVYYCAKDRAYGDYVGWNGFDYWGQGTLVTVSS

SEQ ID NO: 1210 - protein, 108 aa, Artificial Sequence; identical to SEQ ID NO: 10
  Description of Artificial Sequence: Synthetic polypeptide

SEQ ID NO: 1211 - protein, 124 aa, Artificial Sequence
  Description of Artificial Sequence: Synthetic polypeptide
EVQLLESGGGLVQPGGSLRLSCAASGFTFSWYPMWWVRQAPGKGLEWVSYIVPSGGRTYYADSVKGRFTISRDNSKNTLYLQMNSLRAEDTAVYYCAKDRAYGDYVGWNGFDYWGQGTLVTVSS

SEQ ID NO: 1212 - protein, 108 aa, Artificial Sequence; identical to SEQ ID NO: 10
  Description of Artificial Sequence: Synthetic polypeptide

SEQ ID NO: 1213 - protein, 124 aa, Artificial Sequence
  Description of Artificial Sequence: Synthetic polypeptide
EVQLLESGGGLVQPGGSLRLSCAASGFTFSWYSMWWVRQAPGKGLEWVSVIYPSGGGTFYADSVKGRFTISRDNSKNTLYLQMNSLRAEDTAVYYCAKDRAYGDYVGWNGFDYWGQGTLVTVSS

SEQ ID NO: 1214 - protein, 108 aa, Artificial Sequence; identical to SEQ ID NO: 10
  Description of Artificial Sequence: Synthetic polypeptide

SEQ ID NO: 1215 - protein, 124 aa, Artificial Sequence
  Description of Artificial Sequence: Synthetic polypeptide
EVQLLESGGGLVQPGGSLRLSCAASGFTFSWYTMWWVRQAPGKGLEWVSSISPSGGGTYYADSVKGRFTISRDNSKNTLYLQMNSLRAEDTAVYYCAKDRAYGDYVGWNGFDYWGQGTLVTVSS

SEQ ID NO: 1216 - protein, 108 aa, Artificial Sequence; identical to SEQ ID NO: 10
  Description of Artificial Sequence: Synthetic polypeptide

SEQ ID NO: 1217 - protein, 124 aa, Artificial Sequence
  Description of Artificial Sequence: Synthetic polypeptide
EVQLLESGGGLVQPGGSLRLSCAASGFTFSWYYMIWVRQAPGKGLEWVSYISPSGGGTYYADSVKGRFTISRDNSKNTLYLQMNSLRAEDTAVYYCAKDRAYGDYVGWNGFDYWGQGTLVTVSS

SEQ ID NO: 1218 - protein, 108 aa, Artificial Sequence; identical to SEQ ID NO: 10
  Description of Artificial Sequence: Synthetic polypeptide

SEQ ID NO: 1219 - protein, 124 aa, Artificial Sequence
  Description of Artificial Sequence: Synthetic polypeptide
EVQLLESGGGLVQPGGSLRLSCAASGFTFSYYDMIWVRQAPGKGLEWVSWISPSGGLTMYADSVKGRFTISRDNSKNTLYLQMNSLRAEDTAVYYCAKDRAYGDYVGWNGFDYWGQGTLVTVSS

SEQ ID NO: 1220 - protein, 108 aa, Artificial Sequence; identical to SEQ ID NO: 10
  Description of Artificial Sequence: Synthetic polypeptide

SEQ ID NO: 1221 - protein, 124 aa, Artificial Sequence
  Description of Artificial Sequence: Synthetic polypeptide
EVQLLESGGGLVQPGGSLRLSCAASGFTFSYYDMIWVRQAPGKGLEWVSYIVPSGGYTSYADSVKGRFTISRDNSKNTLYLQMNSLRAEDTAVYYCAKDRAYGDYVGWNGFDYWGQGTLVTVSS

SEQ ID NO: 1222 - protein, 108 aa, Artificial Sequence; identical to SEQ ID NO: 10
  Description of Artificial Sequence: Synthetic polypeptide

SEQ ID NO: 1223 - protein, 124 aa, Artificial Sequence
  Description of Artificial Sequence: Synthetic polypeptide
EVQLLESGGGLVQPGGSLRLSCAASGFTFSYYDMVWVRQAPGKGLEWVSYISPSGGFTLYADSVKGRFTISRDNSKNTLYLQMNSLRAEDTAVYYCAKDRAYGDYVGWNGFDYWGQGTLVTVSS

SEQ ID NO: 1224 - protein, 108 aa, Artificial Sequence; identical to SEQ ID NO: 10
  Description of Artificial Sequence: Synthetic polypeptide

SEQ ID NO: 1225 - protein, 124 aa, Artificial Sequence
  Description of Artificial Sequence: Synthetic polypeptide
EVQLLESGGGLVQPGGSLRLSCAASGFTFSYYDMWWVRQAPGKGLEWVSSISPSGGFTGYADSVKGRFTISRDNSKNTLYLQMNSLRAEDTAVYYCAKDRAYGDYVGWNGFDYWGQGTLVTVSS

SEQ ID NO: 1226 - protein, 108 aa, Artificial Sequence; identical to SEQ ID NO: 10
  Description of Artificial Sequence: Synthetic polypeptide

SEQ ID NO: 1227 - protein, 124 aa, Artificial Sequence
  Description of Artificial Sequence: Synthetic polypeptide
EVQLLESGGGLVQPGGSLRLSCAASGFTFSYYDMWWVRQAPGKGLEWVSVISSSGGGTFYADSVKGRFTISRDNSKNTLYLQMNSLRAEDTAVYYCAKDRAYGDYVGWNGFDYWGQGTLVTVSS

SEQ ID NO: 1228 - protein, 108 aa, Artificial Sequence; identical to SEQ ID NO: 10
  Description of Artificial Sequence: Synthetic polypeptide

SEQ ID NO: 1229 - protein, 124 aa, Artificial Sequence
  Description of Artificial Sequence: Synthetic polypeptide
EVQLLESGGGLVQPGGSLRLSCAASGFTFSYYDMWWVRQAPGKGLEWVSVIYPSGGTTFYADSVKGRFTISRDNSKNTLYLQMNSLRAEDTAVYYCAKDRAYGDYVGWNGFDYWGQGTLVTVSS

SEQ ID NO: 1230 - protein, 108 aa, Artificial Sequence; identical to SEQ ID NO: 10
  Description of Artificial Sequence: Synthetic polypeptide

SEQ ID NO: 1231 - protein, 124 aa, Artificial Sequence
  Description of Artificial Sequence: Synthetic polypeptide
EVQLLESGGGLVQPGGSLRLSCAASGFTFSYYDMWWVRQAPGKGLEWVSVIYPSGGYTAYADSVKGRFTISRDNSKNTLYLQMNSLRAEDTAVYYCAKDRAYGDYVGWNGFDYWGQGTLVTVSS

SEQ ID NO: 1232 - protein, 108 aa, Artificial Sequence; identical to SEQ ID NO: 10
  Description of Artificial Sequence: Synthetic polypeptide

SEQ ID NO: 1233 - protein, 124 aa, Artificial Sequence
  Description of Artificial Sequence: Synthetic polypeptide
EVQLLESGGGLVQPGGSLRLSCAASGFTFSYYDMWWVRQAPGKGLEWVSYISSSGGGTYYADSVKGRFTISRDNSKNTLYLQMNSLRAEDTAVYYCAKDRAYGDYVGWNGFDYWGQGTLVTVSS

SEQ ID NO: 1234 - protein, 108 aa, Artificial Sequence; identical to SEQ ID NO: 10
  Description of Artificial Sequence: Synthetic polypeptide

SEQ ID NO: 1235 - protein, 124 aa, Artificial Sequence
  Description of Artificial Sequence: Synthetic polypeptide
EVQLLESGGGLVQPGGSLRLSCAASGFTFSYYEMWWVRQAPGKGLEWVSYISSSGGFTSYADSVKGRFTISRDNSKNTLYLQMNSLRAEDTAVYYCAKDRAYGDYVGWNGFDYWGQGTLVTVSS

SEQ ID NO: 1236 - protein, 108 aa, Artificial Sequence; identical to SEQ ID NO: 10
  Description of Artificial Sequence: Synthetic polypeptide

SEQ ID NO: 1237 - protein, 124 aa, Artificial Sequence
  Description of Artificial Sequence: Synthetic polypeptide
EVQLLESGGGLVQPGGSLRLSCAASGFTFSYYGMWWVRQAPGKGLEWVSVISPSGGGTFYADSVKGRFTISRDNSKNTLYLQMNSLRAEDTAVYYCAKDRAYGDYVGWNGFDYWGQGTLVTVSS

SEQ ID NO: 1238 - protein, 108 aa, Artificial Sequence; identical to SEQ ID NO: 10
  Description of Artificial Sequence: Synthetic polypeptide

SEQ ID NO: 1239 - protein, 124 aa, Artificial Sequence
  Description of Artificial Sequence: Synthetic polypeptide
EVQLLESGGGLVQPGGSLRLSCAASGFTFSYYMMIWVRQAPGKGLEWVSGIVSSGGFTMYADSVKGRFTISRDNSKNTLYLQMNSLRAEDTAVYYCAKDRAYGDYVGWNGFDYWGQGTLVTVSS

SEQ ID NO: 1240 - protein, 108 aa, Artificial Sequence; identical to SEQ ID NO: 10
  Description of Artificial Sequence: Synthetic polypeptide

SEQ ID NO: 1241 - protein, 124 aa, Artificial Sequence
  Description of Artificial Sequence: Synthetic polypeptide
EVQLLESGGGLVQPGGSLRLSCAASGFTFSYYMMWWVRQAPGKGLEWVSSISSSGGGTFYADSVKGRFTISRDNSKNTLYLQMNSLRAEDTAVYYCAKDRAYGDYVGWNGFDYWGQGTLVTVSS

SEQ ID NO: 1242 - protein, 108 aa, Artificial Sequence; identical to SEQ ID NO: 10
  Description of Artificial Sequence: Synthetic polypeptide

SEQ ID NO: 1243 - protein, 124 aa, Artificial Sequence
  Description of Artificial Sequence: Synthetic polypeptide
EVQLLESGGGLVQPGGSLRLSCAASGFTFSYYMMWWVRQAPGKGLEWVSSIYSSGGATFYADSVKGRFTISRDNSKNTLYLQMNSLRAEDTAVYYCAKDRAYGDYVGWNGFDYWGQGTLVTVSS

SEQ ID NO: 1244 - protein, 108 aa, Artificial Sequence; identical to SEQ ID NO: 10
  Description of Artificial Sequence: Synthetic polypeptide

SEQ ID NO: 1245 - protein, 124 aa, Artificial Sequence
  Description of Artificial Sequence: Synthetic polypeptide
EVQLLESGGGLVQPGGSLRLSCAASGFTFSYYNMWWVRQAPGKGLEWVSSISPSGGGTYYADSVKGRFTISRDNSKNTLYLQMNSLRAEDTAVYYCAKDRAYGDYVGWNGFDYWGQGTLVTVSS

SEQ ID NO: 1246 - protein, 108 aa, Artificial Sequence; identical to SEQ ID NO: 10
  Description of Artificial Sequence: Synthetic polypeptide

SEQ ID NO: 1247 - protein, 124 aa, Artificial Sequence
  Description of Artificial Sequence: Synthetic polypeptide
EVQLLESGGGLVQPGGSLRLSCAASGFTFSYYPMFWVRQAPGKGLEWVSYISPSGGWTDYADSVKGRFTISRDNSKNTLYLQMNSLRAEDTAVYYCAKDRAYGDYVGWNGFDYWGQGTLVTVSS

SEQ ID NO: 1248 - protein, 108 aa, Artificial Sequence; identical to SEQ ID NO: 10
  Description of Artificial Sequence: Synthetic polypeptide

SEQ ID NO: 1249 - protein, 124 aa, Artificial Sequence
  Description of Artificial Sequence: Synthetic polypeptide
EVQLLESGGGLVQPGGSLRLSCAASGFTFSYYPMIWVRQAPGKGLEWVSWISPSGGGTQYADSVKGRFTISRDNSKNTLYLQMNSLRAEDTAVYYCAKDRAYGDYVGWNGFDYWGQGTLVTVSS

SEQ ID NO: 1250 - protein, 108 aa, Artificial Sequence; identical to SEQ ID NO: 10
  Description of Artificial Sequence: Synthetic polypeptide

SEQ ID NO: 1251 - protein, 123 aa, Artificial Sequence
  Description of Artificial Sequence: Synthetic polypeptide
EVQLLESGGGLVQPGGSLRLSCAASGFTFSYYPMVWVRQAPGKGLEWVSYIWPSGGTYYADSVKGRFTISRDNSKNTLYLQMNSLRAEDTAVYYCAKDRAYGDYVGWNGFDYWGQGTLVTVSS

SEQ ID NO: 1252 - protein, 108 aa, Artificial Sequence; identical to SEQ ID NO: 10
  Description of Artificial Sequence: Synthetic polypeptide

SEQ ID NO: 1253 - protein, 124 aa, Artificial Sequence
  Description of Artificial Sequence: Synthetic polypeptide
EVQLLESGGGLVQPGGSLRLSCAASGFTFSYYPMWWVRQAPGKGLEWVSSIVPSGGATFYADSVKGRFTISRDNSKNTLYLQMNSLRAEDTAVYYCAKDRAYGDYVGWNGFDYWGQGTLVTVSS

SEQ ID NO: 1254 - protein, 108 aa, Artificial Sequence; identical to SEQ ID NO: 10
  Description of Artificial Sequence: Synthetic polypeptide

SEQ ID NO: 1255 - protein, 124 aa, Artificial Sequence
  Description of Artificial Sequence: Synthetic polypeptide
EVQLLESGGGLVQPGGSLRLSCAASGFTFSYYPMWWVRQAPGKGLEWVSVIYPSGGATFYADSVKGRFTISRDNSKNTLYLQMNSLRAEDTAVYYCAKDRAYGDYVGWNGFDYWGQGTLVTVSS

SEQ ID NO: 1256 - protein, 108 aa, Artificial Sequence; identical to SEQ ID NO: 10
  Description of Artificial Sequence: Synthetic polypeptide

SEQ ID NO: 1257 - protein, 124 aa, Artificial Sequence
  Description of Artificial Sequence: Synthetic polypeptide
EVQLLESGGGLVQPGGSLRLSCAASGFTFSYYPMWWVRQAPGKGLEWVSYISSSGGGTHYADSVKGRFTISRDNSKNTLYLQMNSLRAEDTAVYYCAKDRAYGDYVGWNGFDYWGQGTLVTVSS

SEQ ID NO: 1258 - protein, 108 aa, Artificial Sequence; identical to SEQ ID NO: 10
  Description of Artificial Sequence: Synthetic polypeptide

SEQ ID NO: 1259 - protein, 124 aa, Artificial Sequence
  Description of Artificial Sequence: Synthetic polypeptide
EVQLLESGGGLVQPGGSLRLSCAASGFTFSYYPMWWVRQAPGKGLEWVSYIVPSGGATFYADSVKGRFTISRDNSKNTLYLQMNSLRAEDTAVYYCAKDRAYGDYVGWNGFDYWGQGTLVTVSS

SEQ ID NO: 1260 - protein, 148 aa, Homo sapiens [sequence omitted]

SEQ ID NO: 1261 - DNA, 1955 bp, Homo sapiens
acactttgcgttccgcggccccggccccttggtttcctagtcctggctccattcccctctcaggcctagggctgggacccctccccgcccccggtcttggccctgcccccttcaacagacggtccgccccggcccctccccctcgtcccgcccggccctggcaggccccgccccctgcggcctctacctttgacgtcttcccccgggaggtggcgggggtctgcgaccgaatgccggcgggactctgggtcagggcttctggcgggccctgcggggggcagcgaggtgaccgtgaacctgcggctcatggcgcggaaaggagccaggcggccgcggcaaggtccgggatcgcacaagtggctgcaaccaggctctaggagggagaaagagcggatcccccaaccccctccgcccgcccgccccccgcgagacgcggcgccgcgcagggtcctagtgcccgctgtgcgaagggttcctgaatctggccacttcgctgggaggccctgggctccccagtgccacccgaagggcctgaggaggccatctgcagaatctcactctgtcgcccaggccggagtgcagtgtcatgatcttggctcactgcaacctccgcctcccagttcaggagattctcctgcctcagcctcccgggtggctgggattacaagcacagtgcctggcacattatcggcacttgatgactgttgtctaataactgagcttccatacaaaccacctgccgtcctgtactgaaggagaaagagcttccagccggggaggcaggaaatctgggtcctggtcttggttgcatccctgacttcctaaatgacctggagaaggcctctgcctctgctgggatcttgtctgtgctggggcatttgtttccatttccaagggctttttcttcctcgctcagaatttgaccactcactaagaggagcttagtgtggtgtctcacgaagggatcctcctcagccctcacctcggtactggaagacgtcgtgcgtgtccaaaggcaccccggggaacatccggtccacctcgctggcgctccggggatccaccatctgcgccttcacgtcgaacctgcgggcaggcgcggaggagacaggtgctgagccggctagcggacggaccgacggcgcccgggctccccctgccggcggccgcggcggcgctcacctccagaggcgccgcccgctgaacagcagcatcttccccctgccactccggagggccccggtcacctgggccacgtcggcgcccaggcccagcttgtccagacgcctcgggcccagcaccgacgcgcctgtgtacacccacacctggcgccctgcaggggaggagggtcacgtcggtttgggggcgcagagggagcacgtactcctagaacgcgaggagggagattccggcgaggcctttcctagcccgcgtgcccgcagtccctgcaacccaggggcagaggcgctgggtagagcgacgcgagggcgtggagaggagggggcagaaactcagccgcccctacgtttgctaaactgcgtccgccagggggcgtatttttctaaaacgcacaagacgtttcgtgggttatcgatggtctcttgagcctccttgactgatggggattgaccgggcgggggagggaaagtaggtaactaaccagagaagaagaaaagcttcttggagagcggctcctcaaagaccgagtccagcttgcggggcagcgcgggccacttgtcggcgataaggaaggggccctgcggccggctccccctgccctcagagaatcgccagtacttcctgagaaagcgaggagggaaaggacgggctctaagccttggacacagggccagtgggcgggaagggacgggcagcccctccgcaaagccccctcccgcatccacacaaccccgcctcctcacccatccttgaacaaatacagctggttcccaatc

SEQ ID NO: 1262 - protein, 730 aa, Mus musculus
MSPWQPLLLALLAFGCSSAAPYQRQPTFVVFPKDLKTSNLTDTQLAEAYLYRYGYTRAAQMMGEKQSLRPALLMLQKQLSLPQTGELDSQTLKAIRTPRCGVPDVGRFQTFKGLKWDHHNITYWIQNYSEDLPRDMIDDAFARAFAVWGEVAPLTFTRVYGPEADIVIQFGVAEHGDGYPFDGKDGLLAHAFPPGAGVQGDAHFDDDELWSLGKGVVIPTYYGNSNGAPCHFPFTFEGRSYSACTTDGRNDGTPWCSTTADYDKDGKFGFCPSERLYTEHGNGEGKPCVFPFIFEGRSYSACTTKGRSDGYRWCATTANYDQDKLYGFCPTRVDATVVGGNSAGELCVFPFVFLGKQYSSCTSDGRRDGRLWCATTSNFDTDKKWGFCPDQGYSLFLVAAHEFGHALGLDHSSVPEALMYPLYSYLEGFPLNKDDIDGIQYLYGRGSKPDPRPPATTTTEPQPTAPPTMCPTIPPTAYPTVGPTVGPTGAPSPGPTSSPSPGPTGAPSPGPTAPPTAGSSEASTESLSPADNPCNVDVFDAIAEIQGALHFFKDGWYWKFLNHRGSPLQGPFLTARTWPALPATLDSAFEDPQTKRVFFFSGRQMWVYTGKTVLGPRSLDKLGLGPEVTHVSGLLPRRLGKALLFSKGRVWRFDLKSQKVDPQSVIRVDKEFSGVPWNSHDIFQYQDKAYFCHGKFFWRVSFQNEVNKVDHEVNQVDDVGYVTYDLLQCP

SEQ ID NO: 1263 - DNA, 3185 bp, Mus musculus
ctcaccatgagtccctggcagcccctgctcctggctctcctggctttcggctgcagctctgctgccccttaccagcgccagccgacttttgtggtcttccccaaagacctgaaaacctccaacctcacggacacccagctggcagaggcatacttgtaccgctatggttacacccgggccgcccagatgatgggagagaagcagtctctacggccggctttgctgatgcttcagaagcagctctccctgccccagactggtgagctggacagccagacactaaaggccattcgaacaccacgctgtggtgtcccagacgtgggtcgattccaaaccttcaaaggcctcaagtgggaccatcataacatcacatactggatccaaaactactctgaagacttgccgcgagacatgatcgatgacgccttcgcgcgcgccttcgcggtgtggggcgaggtggcacccctcaccttcacccgcgtgtacggacccgaagcggacattgtcatccagtttggtgtcgcggagcacggagacgggtatcccttcgacggcaaggacggccttctggcacacgcctttccccctggcgccggcgttcagggagatgcccatttcgacgacgacgagttgtggtcgctgggcaaaggcgtcgtgatccccacttactatggaaactcaaatggtgccccatgtcactttcccttcaccttcgagggacgctcctattcggcctgcaccacagacggccgcaacgacggcacgccttggtgtagcacaacagctgactacgataaggacggcaaatttggtttctgccctagtgagagactctacacggagcacggcaacggagaaggcaaaccctgtgtgttcccgttcatctttgagggccgctcctactctgcctgcaccactaaaggccgctcggatggttaccgctggtgcgccaccacagccaactatgaccaggataaactgtatggcttctgccctacccgagtggacgcgaccgtagttgggggcaactcggcaggagagctgtgcgtcttccccttcgtcttcctgggcaagcagtactcttcctgtaccagcgacggccgcagggatgggcgcctctggtgtgcgaccacatcgaacttcgacactgacaagaagtggggtttctgtccagaccaagggtacagcctgttcctggtggcagcgcacgagttcggccatgcactgggcttagatcattccagcgtgccggaagcgctcatgtacccgctgtatagctacctcgagggcttccctctgaataaagacgacatagacggcatccagtatctgtatggtcgtggctctaagcctgacccaaggcctccagccaccaccacaactgaaccacagccgacagcacctcccactatgtgtcccactatacctcccacggcctatcccacagtgggccccacggttggccctacaggcgccccctcacctggccccacaagcagcccgtcacctggccctacaggcgccccctcacctggccctacagcgccccctactgcgggctcttctgaggcctctacagagtctttgagtccggcagacaatccttgcaatgtggatgtttttgatgctattgctgagatccagggcgctctgcatttcttcaaggacggttggtactggaagttcctgaatcatagaggaagcccattacagggccccttccttactgcccgcacgtggccagccctgcctgcaacgctggactccgcctttgaggatccgcagaccaagagggttttcttcttctctggacgtcaaatgtgggtgtacacaggcaagaccgtgctgggccccaggagtctggataagttgggtctaggcccagaggtaacccacgtcagcgggcttctcccgcgtcgtctcgggaaggctctgctgttcagcaaggggcgtgtctggagattcgacttgaagtctcagaaggtggatccccagagcgtcattcgcgtggataaggagttctctggtgtgccctggaactcacacgacatcttccagtaccaagacaaagcctatttctgccatggcaaattcttctggcgtgtgagtttccaaaatgaggtgaacaaggtggaccatgaggtgaaccaggtggacgacgtgggctacgtgacctacgacctcctgcagtgcccttgaactagggctccttctttgcttcaaccgtgcagtgcaagtctctagagaccaccaccaccaccaccacacacaaaccccatccgagggaaaggtgctagctggccaggtacagactggtgatctcttctagagactgggaaggagtggaggcaggcagggctctctctgcccaccgtcctttcttgttggactgtttctaataaacacggatccccaaccttttccagctactttagtcaatcagcttatctgtagttgcagatgcatccgagcaagaagacaactttgtagggtggattctgaccttttatttttgtgtggcgtctgagaattgaatcagctggcttttgtgacaggcacttcaccggctaaaccacctctcccgactccagcccttttatttattatgtatgaggttatgttcacatgcatgtatttaacccacagaatgcttactgtgtgtcgggcgcggctccaaccgctgcataaatattaaggtattcagttgcccctactggaaggtattatgtaactatttctctcttacattggagaacaccaccgagctatccactcatcaaacatttattgagagcatccctagggagccaggctctctactgggcgttagggacagaaatgttggttcttccttcaaggattgctcagagattctccgtgtcctgtaaatctgctgaaaccagaccccagactcctctctctcccgagagtccaactcactcactgtggttgctggcagctgcagcatgcgtatacagcatgtgtgctagagaggtagagggggtctgtgcgttatggttcaggtcagactgtgtcctccaggtgagatgacccctcagctggaactgatccaggaaggataaccaagtgtcttcctggcagtcttttttaaataaatgaataaatgaatatttacttaaaaaaaaaaaaaaaaaaaaaaaaaaaaaaaaaaaaaaaaaaaaaaa

SEQ ID NO: 1264 - protein, 730 aa, Mus musculus; identical to SEQ ID NO: 1262

SEQ ID NO: 1265 - DNA, 21 bp, Artificial Sequence
  Description of Combined DNA/RNA Molecule: Synthetic oligonucleotide
  Description of Artificial Sequence: Synthetic oligonucleotide
gacuugccgcgagacaugatt

SEQ ID NO: 1266 - DNA, 21 bp, Artificial Sequence
  Description of Combined DNA/RNA Molecule: Synthetic oligonucleotide
  Description of Artificial Sequence: Synthetic oligonucleotide
ucaugucucgcggcaaguctt

SEQ ID NO: 1267 - DNA, 21 bp, Artificial Sequence
  Description of Combined DNA/RNA Molecule: Synthetic oligonucleotide
  Description of Artificial Sequence: Synthetic oligonucleotide
gacuucgcgggacacaugatt

SEQ ID NO: 1268 - DNA, 21 bp, Artificial Sequence
  Description of Combined DNA/RNA Molecule: Synthetic oligonucleotide
  Description of Artificial Sequence: Synthetic oligonucleotide
ucaugugucccgcgaaguctt

SEQ ID NO: 1269 - DNA, 3065 bp, Homo sapiens
ctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgacgcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggctttcccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatcctttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtgaaaaaaaaaaaaaaaaaaaaa

SEQ ID NO: 1270 - protein, 660 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 1271 - DNA, 3070 bp, Mus musculus
ccagccggccacatctggcgtctgcccgcccttgtttccgctgcatccagacttccctggtggctggaggctctgtgtgcatccaggagtttagatatacaaagggattgccaggacctgcaagcacccgcggcagtggtgtgtattgggacgtgggaccccgttatgagctcctgagccccgagaagcagaggcagtagagtaaggggatcgccgtgcagggcaggcgccagccgggcggaccccagggcacagccagagacctcagggtgacacgcggagcccgggagcgcaacgatggaggcacgagtggcctggggagcgctggccggacctctgcgggttctctgcgtcctgtgctgcctgttgggccgcgccatcgctgcaccatcgcccatcatcaagttccccggcgatgtcgcccctaaaacagacaaagagttggcagtgcaatacctgaacactttctatggctgccccaaggagagttgcaacctctttgtgctgaaagataccctcaagaagatgcagaagttctttgggctgccccagacaggtgaccttgaccagaacaccatcgagaccatgcggaagccaagatgtggcaacccagatgtggccaactacaacttcttcccccgcaagcccaagtgggacaagaaccagatcacatacaggatcattggttacacacctgacctggaccctgaaaccgtggatgatgcttttgctcgggccttaaaagtatggagcgacgtcactccgctgcgcttttctcgaatccatgatggggaggctgacatcatgatcaactttggacgctgggagcatggagatggatacccatttgatggcaaggatggactcctggcacatgcctttgccccgggcactggtgttgggggagattctcactttgatgatgatgagctgtggaccctgggagaaggacaagtggtccgcgtaaagtatgggaacgctgatggcgagtactgcaagttccccttcctgttcaacggtcgggaatacagcagctgtacagacactggtcgcagtgatggcttcctctggtgctccaccacatacaactttgagaaggatggcaagtatggcttctgcccccatgaagccttgtttaccatgggtggcaatgcagatggacagccctgcaagttcccgttccgcttccagggcacctcctacaacagctgtaccaccgagggccgcaccgatggctaccgctggtgtggcaccaccgaggactatgaccgggataagaagtatggattctgtcccgagaccgctatgtccactgtgggtggaaattcagaaggtgccccatgtgtcttccccttcactttcctgggcaacaagtatgagagctgcaccagcgccggccgcaacgatggcaaggtgtggtgtgcgaccacaaccaactacgatgatgaccggaagtggggcttctgtcctgaccaaggatatagcctattcctcgtggcagcccatgagttcggccatgccatggggctggaacactctcaggaccctggagctctgatggccccgatctacacctacaccaagaacttccgattatcccatgatgacatcaaggggatccaggagctctatgggccctcccccgatgctgatactgacactggtactggccccacaccaacactgggacctgtcactccggagatctgcaaacaggacattgtctttgatggcatcgctcagatccgtggtgagatcttcttcttcaaggaccggtttatttggcggacagtgacaccacgtgacaagcccacaggtcccttgctggtggccacattctggcctgagctcccagaaaagattgacgctgtgtatgaggccccacaggaggagaaggctgtgttcttcgcagggaatgagtactgggtctattctgctagtactctggagcgaggataccccaagccactgaccagcctggggttgccccctgatgtccagcaagtagatgctgcctttaactggagtaagaacaagaagacatacatctttgcaggagacaagttctggagatacaatgaagtgaagaagaaaatggaccccggtttccctaagctcatcgcagactcctggaatgccatccctgataacctggatgccgtcgtggacctgcagggtggtggtcatagctacttcttcaagggtgcttattacctgaagctggagaaccaaagtctcaagagcgtgaagtttggaagcatcaaatcagactggctgggctgctgagctggccctgttcccacgggccctatcatcttcatcgctgcacaccaggtgaaggatgtgaagcagcctggcggctctgtcctcctctgtagttaaccagccttctccttcacctggtgacttcagatttaagagggtggcttctttttgtgcccaaagaaaggtgctgactgtaccctcccgggtgctgcttctccttcctgcccaccctaggggatgcttggatatttgcaatgcagccctcctctgggctgccctggtgctccactcttctggttcttcaacatctatgacctttttatggctttcagcactctcagagttaatagagactggcttaggagggcactggtggccctgttaacagcctggcatggggcagtggggtacaggtgtgccaaggtggaaatcagagacacctggtttcaccctttctgctgcccagacacctgcaccaccttaactgttgcttttgtatgcccttcgctcgtttccttcaaccttttcagttttccactccactgcatttcctgcccaaaggactcgggttgtctgacatcgctgcatgatgcatctcagcccgcctagtgatggttcccctcctcactctgtgcagatcatgcccagtcacttcctccactggatggaggagaaccaagtcagtggcttcctgctcagccttcttgcttctccctttaacagttccccatgggaaatggcaaacaagtataaataaagacacccattgagtgacaaaaaaaaaaaaaaaaaaaaaaaaaaaaaa

SEQ ID NO: 1272 - protein, 662 aa, Mus musculus
MEARVAWGALAGPLRVLCVLCCLLGRAIAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARALKVWSDVTPLRFSRIHDGEADIMINFGRWEHGDGYPFDGKDGLLAHAFAPGTGVGGDSHFDDDELWTLGEGQVVRVKYGNADGEYCKFPFLFNGREYSSCTDTGRSDGFLWCSTTYNFEKDGKYGFCPHEALFTMGGNADGQPCKFPFRFQGTSYNSCTTEGRTDGYRWCGTTEDYDRDKKYGFCPETAMSTVGGNSEGAPCVFPFTFLGNKYESCTSAGRNDGKVWCATTTNYDDDRKWGFCPDQGYSLFLVAAHEFGHAMGLEHSQDPGALMAPIYTYTKNFRLSHDDIKGIQELYGPSPDADTDTGTGPTPTLGPVTPEICKQDIVFDGIAQIRGEIFFFKDRFIWRTVTPRDKPTGPLLVATFWPELPEKIDAVYEAPQEEKAVFFAGNEYWVYSASTLERGYPKPLTSLGLPPDVQQVDAAFNWSKNKKTYIFAGDKFWRYNEVKKKMDPGFPKLIADSWNAIPDNLDAVVDLQGGGHSYFFKGAYYLKLENQSLKSVKFGSIKSDWLGC

SEQ ID NO: 1273 - DNA, 21 bp, Artificial Sequence
  Description of Combined DNA/RNA Molecule: Synthetic oligonucleotide
  Description of Artificial Sequence: Synthetic oligonucleotide
cuuuagauauacaaagggatt

SEQ ID NO: 1274 - DNA, 21 bp, Artificial Sequence
  Description of Combined DNA/RNA Molecule: Synthetic oligonucleotide
  Description of Artificial Sequence: Synthetic oligonucleotide
ucccuuuguauaucuaaagtt

SEQ ID NO: 1275 - DNA, 21 bp, Artificial Sequence
  Description of Combined DNA/RNA Molecule: Synthetic oligonucleotide
  Description of Artificial Sequence: Synthetic oligonucleotide
ggagaguugcaaccucuuutt

SEQ ID NO: 1276 - DNA, 21 bp, Artificial Sequence
  Description of Combined DNA/RNA Molecule: Synthetic oligonucleotide
  Description of Artificial Sequence: Synthetic oligonucleotide
aaagagguugcaacucucctt

SEQ ID NO: 1277 - protein, 4 aa, Artificial Sequence
  Description of Artificial Sequence: Synthetic peptide
GFLG

SEQ ID NO: 1278 - protein, 8 aa, Artificial Sequence
  Description of Artificial Sequence: Synthetic peptide
  MOD_RES (1)..(1): (7-methoxycoumarin-4-yl)acetic acid-Pro
  MOD_RES (4)..(4): Cys(methoxybenzyl)
  MOD_RES (8)..(8): 2,3-diaminopropionic acid(2,4-dinitrophenyl)
  C-term amidated
PLACWARX

SEQ ID NO: 1279 - protein, 8 aa, Artificial Sequence
  Description of Artificial Sequence: Synthetic peptide
  MOD_RES (1)..(1): (7-methoxycoumarin-4-yl)acetic acid-Lys
  MOD_RES (6)..(6): 2,3-diaminopropionic acid(2,4-dinitrophenyl)
  C-term amidated
KPLGLXAR

SEQ ID NO: 1280 - protein, 110 aa, Artificial Sequence
  Description of Artificial Sequence: Synthetic polypeptide
QYELTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTLVFGGGTKLTVL

SEQ ID NO: 1281 - protein, 124 aa, Artificial Sequence
  Description of Artificial Sequence: Synthetic polypeptide
EVQLLESGGGLVQPGGSLRLSCAASGFTFSTYQMVWVRQAPGKGLEWVSVIYPSGGPTVYADSVKGRFTISRDNSKNTLYLQMNSLRAEDTAVYYCARGEDYYDSSGPGAFDIWGQGTMVTVSS

SEQ ID NO: 1282 - DNA, 372 bp, Artificial Sequence
  Description of Artificial Sequence: Synthetic polynucleotide
ttctattctcacagtgcacagagcgaattgactcagccaccgtcagcgtctgcggcccccgggcagagggtcaccatctcttgttctggaagcagctccaacatcggaagtaacactgtaacctggtaccagaagctcccaggaacggcccccaagctcctcatttacaataattatgagcggccctcaggggtccctgcccgattctctggctccaagtctggcacctcagcctccctggccatcagtgggctccagtctgaggatgaggctgattattactgtgcaacatgggatgacagcctgattgccaattacgtcttcggaagtgggaccaaggtcaccgtcctaggtcagcccaaggccaacccc

SEQ ID NO: 1283 - protein, 124 aa, Artificial Sequence
  Description of Artificial Sequence: Synthetic polypeptide
FYSHSAQSELTQPPSASAAPGQRVTISCSGSSSNIGSNTVTWYQKLPGTAPKLLIYNNYERPSGVPARFSGSKSGTSASLAISGLQSEDEADYYCATWDDSLIANYVFGSGTKVTVLGQPKANP

SEQ ID NO: 1284 - protein, 115 aa, Artificial Sequence
  Description of Artificial Sequence: Synthetic polypeptide
EVQLLESGGGLVQPGGSLRLSCAASGFTFSLYSMNWVRQAPGKGLEWVSSIYSSGGSTLYADSVKGRFTISRDNSKNTLYLQMNSLRAEDTAVYYCARGRAFDIWGQGTMVTVSS

SEQ ID NO: 1285 - protein, 108 aa, Artificial Sequence
  Description of Artificial Sequence: Synthetic polypeptide
DIQMTQSPSSLSASVGDRVTITCRASQSVGTYLNWYQQKPGKAPKLLIYATSNLRSGVPSRFSGSGSGTDFTLTISSLQPEDFATYYCQQSYSIPRFTFGPGTKVDIK

SEQ ID NO: 1286 - protein, 11 aa, Artificial Sequence
  Description of Artificial Sequence: Synthetic peptide
RASQSISSFLA

SEQ ID NO: 1287 - protein, 7 aa, Artificial Sequence
  Description of Artificial Sequence: Synthetic peptide
DASYRAT

SEQ ID NO: 1288 - protein, 9 aa, Artificial Sequence
  Description of Artificial Sequence: Synthetic peptide
QQRGNWPIT

SEQ ID NO: 1289 - protein, 5 aa, Artificial Sequence
  Description of Artificial Sequence: Synthetic peptide
QYPMW

SEQ ID NO: 1290 - protein, 17 aa, Artificial Sequence
  Description of Artificial Sequence: Synthetic peptide
YIVPSGGRTYYADSVKG

SEQ ID NO: 1291 - protein, 15 aa, Artificial Sequence
  Description of Artificial Sequence: Synthetic peptide
DRAYGDYVGWNGFDY

SEQ ID NO: 1292 - protein, 11 aa, Artificial Sequence
  Description of Artificial Sequence: Synthetic peptide
RASQNVARFLA

SEQ ID NO: 1293 - protein, 7 aa, Artificial Sequence
  Description of Artificial Sequence: Synthetic peptide
SASNRAT

SEQ ID NO: 1294 - protein, 9 aa, Artificial Sequence
  Description of Artificial Sequence: Synthetic peptide
QQRGNWPIT

SEQ ID NO: 1295 - protein, 5 aa, Artificial Sequence
  Description of Artificial Sequence: Synthetic peptide
QYPMW

SEQ ID NO: 1296 - protein, 17 aa, Artificial Sequence
  Description of Artificial Sequence: Synthetic peptide
YIVPSGGRTYYADSVKG

SEQ ID NO: 1297 - protein, 15 aa, Artificial Sequence
  Description of Artificial Sequence: Synthetic peptide
DRAYGDYVGWNGFDY

SEQ ID NO: 1298 - protein, 11 aa, Artificial Sequence
  Description of Artificial Sequence: Synthetic peptide
RASQNVHTYLA

SEQ ID NO: 1299 - protein, 7 aa, Artificial Sequence
  Description of Artificial Sequence: Synthetic peptide
EASNRAT

SEQ ID NO: 1300 - protein, 9 aa, Artificial Sequence
  Description of Artificial Sequence: Synthetic peptide
QQRGGWPIT

SEQ ID NO: 1301 - protein, 5 aa, Artificial Sequence
  Description of Artificial Sequence: Synthetic peptide
QYPMW

SEQ ID NO: 1302 - protein, 17 aa, Artificial Sequence
  Description of Artificial Sequence: Synthetic peptide
YIVPSGGRTYYADSVKG

SEQ ID NO: 1303 - protein, 15 aa, Artificial Sequence
  Description of Artificial Sequence: Synthetic peptide
DRAYGDYVGWNGFDY

SEQ ID NO: 1304 - protein, 11 aa, Artificial Sequence
  Description of Artificial Sequence: Synthetic peptide
RASQSISSFLA

SEQ ID NO: 1305 - protein, 7 aa, Artificial Sequence
  Description of Artificial Sequence: Synthetic peptide
DASYRAT

SEQ ID NO: 1306 - protein, 9 aa, Artificial Sequence
  Description of Artificial Sequence: Synthetic peptide
QQRGNWPIT

SEQ ID NO: 1307 - protein, 5 aa, Artificial Sequence
  Description of Artificial Sequence: Synthetic peptide
VYPMI

SEQ ID NO: 1308 - protein, 17 aa, Artificial Sequence
  Description of Artificial Sequence: Synthetic peptide
YISPSGGFTGYADSVKG

SEQ ID NO: 1309 - protein, 15 aa, Artificial Sequence
  Description of Artificial Sequence: Synthetic peptide
DRAYGDYVGWNGFDY

SEQ ID NO: 1310 - protein, 11 aa, Artificial Sequence
  Description of Artificial Sequence: Synthetic peptide
RASQSISSFLA

SEQ ID NO: 1311 - protein, 7 aa, Artificial Sequence
  Description of Artificial Sequence: Synthetic peptide
DASYRAT

SEQ ID NO: 1312 - protein, 9 aa, Artificial Sequence
  Description of Artificial Sequence: Synthetic peptide
QQRGNWPIT

SEQ ID NO: 1313 - protein, 5 aa, Artificial Sequence
  Description of Artificial Sequence: Synthetic peptide
DYPMW

SEQ ID NO: 1314 - protein, 17 aa, Artificial Sequence
  Description of Artificial Sequence: Synthetic peptide
VIYPSGGATFYADSVKG

SEQ ID NO: 1315 - protein, 15 aa, Artificial Sequence
  Description of Artificial Sequence: Synthetic peptide
DRAYGDYVGWNGFDY

SEQ ID NO: 1316 - protein, 11 aa, Artificial Sequence
  Description of Artificial Sequence: Synthetic peptide
RASQSISSFLA

SEQ ID NO: 1317 - protein, 7 aa, Artificial Sequence
  Description of Artificial Sequence: Synthetic peptide
DASYRAT

SEQ ID NO: 1318 - protein, 9 aa, Artificial Sequence
  Description of Artificial Sequence: Synthetic peptide
QQRGNWPIT

SEQ ID NO: 1319 - protein, 5 aa, Artificial Sequence
  Description of Artificial Sequence: Synthetic peptide
TYPMI

SEQ ID NO: 1320 - protein, 17 aa, Artificial Sequence
  Description of Artificial Sequence: Synthetic peptide
YISPSGGYTGYADSVKG

SEQ ID NO: 1321 - protein, 15 aa, Artificial Sequence
  Description of Artificial Sequence: Synthetic peptide
DRAYGDYVGWNGFDY

SEQ ID NO: 1322 - protein, 11 aa, Artificial Sequence
  Description of Artificial Sequence: Synthetic peptide
RASQSISSFLA

SEQ ID NO: 1323 - protein, 7 aa, Artificial Sequence
  Description of Artificial Sequence: Synthetic peptide
DASYRAT

SEQ ID NO: 1324 - protein, 9 aa, Artificial Sequence
  Description of Artificial Sequence: Synthetic peptide
QQRGNWPIT

SEQ ID NO: 1325 - protein, 5 aa, Artificial Sequence
  Description of Artificial Sequence: Synthetic peptide
HYDMW

SEQ ID NO: 1326 - protein, 17 aa, Artificial Sequence
  Description of Artificial Sequence: Synthetic peptide
VIYSSGGPTFYADSVKG

SEQ ID NO: 1327 - protein, 15 aa, Artificial Sequence
  Description of Artificial Sequence: Synthetic peptide
DRAYGDYVGWNGFDY

SEQ ID NO: 1328 - protein, 11 aa, Artificial Sequence
  Description of Artificial Sequence: Synthetic peptide
RASQSISSFLA

SEQ ID NO: 1329 - protein, 7 aa, Artificial Sequence
  Description of Artificial Sequence: Synthetic peptide
DASYRAT

SEQ ID NO: 1330 - protein, 9 aa, Artificial Sequence
  Description of Artificial Sequence: Synthetic peptide
QQRGNWPIT

SEQ ID NO: 1331 - protein, 5 aa, Artificial Sequence
  Description of Artificial Sequence: Synthetic peptide
HYPMW

SEQ ID NO: 1332 - protein, 17 aa, Artificial Sequence
  Description of Artificial Sequence: Synthetic peptide
SISPSGGATYYADSVKG

SEQ ID NO: 1333 - protein, 15 aa, Artificial Sequence
  Description of Artificial Sequence: Synthetic peptide
DRAYGDYVGWNGFDY

SEQ ID NO: 1334 - protein, 11 aa, Artificial Sequence
  Description of Artificial Sequence: Synthetic peptide
RASQSISSFLA

SEQ ID NO: 1335 - protein, 7 aa, Artificial Sequence
  Description of Artificial Sequence: Synthetic peptide
DASYRAT

SEQ ID NO: 1336 - protein, 9 aa, Artificial Sequence
  Description of Artificial Sequence: Synthetic peptide
QQRGNWPIT

SEQ ID NO: 1337 - protein, 5 aa, Artificial Sequence
  Description of Artificial Sequence: Synthetic peptide
KYPMW

SEQ ID NO: 1338 - protein, 17 aa, Artificial Sequence
  Description of Artificial Sequence: Synthetic peptide
SIYPSGGATFYADSVKG

SEQ ID NO: 1339 - protein, 15 aa, Artificial Sequence
  Description of Artificial Sequence: Synthetic peptide
DRAYGDYVGWNGFDY

SEQ ID NO: 1340 - protein, 11 aa, Artificial Sequence
  Description of Artificial Sequence: Synthetic peptide
RASQSISSFLA

SEQ ID NO: 1341 - protein, 7 aa, Artificial Sequence
  Description of Artificial Sequence: Synthetic peptide
DASYRAT

SEQ ID NO: 1342 - protein, 9 aa, Artificial Sequence
  Description of Artificial Sequence: Synthetic peptide
QQRGNWPIT

SEQ ID NO: 1343 - protein, 5 aa, Artificial Sequence
  Description of Artificial Sequence: Synthetic peptide
HYDML

SEQ ID NO: 1344 - protein, 17 aa, Artificial Sequence
  Description of Artificial Sequence: Synthetic peptide
YISSSGGYTGYADSVKG

SEQ ID NO: 1345 - protein, 15 aa, Artificial Sequence
  Description of Artificial Sequence: Synthetic peptide
DRAYGDYVGWNGFDY

SEQ ID NO: 1346 - protein, 11 aa, Artificial Sequence
  Description of Artificial Sequence: Synthetic peptide
RASQSISSFLA

SEQ ID NO: 1347 - protein, 7 aa, Artificial Sequence
  Description of Artificial Sequence: Synthetic peptide
DASYRAT

SEQ ID NO: 1348 - protein, 9 aa, Artificial Sequence
  Description of Artificial Sequence: Synthetic peptide
QQRGNWPIT

SEQ ID NO: 1349 - protein, 5 aa, Artificial Sequence
  Description of Artificial Sequence: Synthetic peptide
KYPMW

SEQ ID NO: 1350 - protein, 17 aa, Artificial Sequence
  Description of Artificial Sequence: Synthetic peptide
YISSSGGGTFYADSVKG

SEQ ID NO: 1351 - protein, 15 aa, Artificial Sequence
  Description of Artificial Sequence: Synthetic peptide
DRAYGDYVGWNGFDY

SEQ ID NO: 1352 - protein, 11 aa, Artificial Sequence
  Description of Artificial Sequence: Synthetic peptide
RASQSISSFLA

SEQ ID NO: 1353 - protein, 7 aa, Artificial Sequence
  Description of Artificial Sequence: Synthetic peptide
DASYRAT

SEQ ID NO: 1354 - protein, 9 aa, Artificial Sequence
  Description of Artificial Sequence: Synthetic peptide
QQRGNWPIT

SEQ ID NO: 1355 - protein, 5 aa, Artificial Sequence
  Description of Artificial Sequence: Synthetic peptide
LYDMW

SEQ ID NO: 1356 - protein, 17 aa, Artificial Sequence
  Description of Artificial Sequence: Synthetic peptide
YISSSGGATFYADSVKG

SEQ ID NO: 1357 - protein, 15 aa, Artificial Sequence
  Description of Artificial Sequence: Synthetic peptide
DRAYGDYVGWNGFDY

SEQ ID NO: 1358 - protein, 11 aa, Artificial Sequence
  Description of Artificial Sequence: Synthetic peptide
RASQSISSFLA

SEQ ID NO: 1359 - protein, 7 aa, Artificial Sequence
  Description of Artificial Sequence: Synthetic peptide
DASYRAT

SEQ ID NO: 1360 - protein, 9 aa, Artificial Sequence
  Description of Artificial Sequence: Synthetic peptide
QQRGNWPIT

SEQ ID NO: 1361 - protein, 5 aa, Artificial Sequence
  Description of Artificial Sequence: Synthetic peptide
RYPMW

SEQ ID NO: 1362 - protein, 17 aa, Artificial Sequence
  Description of Artificial Sequence: Synthetic peptide
YISPSGGFTSYADSVKG

SEQ ID NO: 1363 - protein, 15 aa, Artificial Sequence
  Description of Artificial Sequence: Synthetic peptide
DRAYGDYVGWNGFDY

SEQ ID NO: 1364 - protein, 11 aa, Artificial Sequence
  Description of Artificial Sequence: Synthetic peptide
RASQSVGRFLA

SEQ ID NO: 1365 - protein, 7 aa, Artificial Sequence
  Description of Artificial Sequence: Synthetic peptide
GASSRAT

SEQ ID NO: 1366 - protein, 9 aa, Artificial Sequence
  Description of Artificial Sequence: Synthetic peptide
QQRGNWPIT

SEQ ID NO: 1367 - protein, 5 aa, Artificial Sequence
  Description of Artificial Sequence: Synthetic peptide
QYPMW

SEQ ID NO: 1368 - protein, 17 aa, Artificial Sequence
  Description of Artificial Sequence: Synthetic peptide
YIVPSGGRTYYADSVKG

SEQ ID NO: 1369 - protein, 15 aa, Artificial Sequence
  Description of Artificial Sequence: Synthetic peptide
DRAYGDYVGWNGFDY

SEQ ID NO: 1370 - protein, 11 aa, Artificial Sequence
  Description of Artificial Sequence: Synthetic peptide
RASQNIGSDLA

SEQ ID NO: 1371 - protein, 7 aa, Artificial Sequence
  Description of Artificial Sequence: Synthetic peptide
GASSRAT

SEQ ID NO: 1372 - protein, 9 aa, Artificial Sequence
  Description of Artificial Sequence: Synthetic peptide
QQRGNWPIT

SEQ ID NO: 1373 - protein, 5 aa, Artificial Sequence
  Description of Artificial Sequence: Synthetic peptide
QYPMW

SEQ ID NO: 1374 - protein, 17 aa, Artificial Sequence
  Description of Artificial Sequence: Synthetic peptide
YIVPSGGRTYYADSVKG

SEQ ID NO: 1375 - protein, 15 aa, Artificial Sequence
  Description of Artificial Sequence: Synthetic peptide
DRAYGDYVGWNGFDY

SEQ ID NO: 1376 - protein, 11 aa, Artificial Sequence
  Description of Artificial Sequence: Synthetic peptide
RASQSVGNFLA

SEQ ID NO: 1377 - protein, 7 aa, Artificial Sequence
  Description of Artificial Sequence: Synthetic peptide
GASNRAT

SEQ ID NO: 1378 - protein, 9 aa, Artificial Sequence
  Description of Artificial Sequence: Synthetic peptide
QQRGNWPIT

SEQ ID NO: 1379 - protein, 5 aa, Artificial Sequence
  Description of Artificial Sequence: Synthetic peptide
QYPMW

SEQ ID NO: 1380 - protein, 17 aa, Artificial Sequence
  Description of Artificial Sequence: Synthetic peptide
YIVPSGGRTYYADSVKG

SEQ ID NO: 1381 - protein, 15 aa, Artificial Sequence
  Description of Artificial Sequence: Synthetic peptide
DRAYGDYVGWNGFDY

SEQ ID NO: 1382 - protein, 11 aa, Artificial Sequence
  Description of Artificial Sequence: Synthetic peptide
RASQVIFSGLA

SEQ ID NO: 1383 - protein, 7 aa, Artificial Sequence
  Description of Artificial Sequence: Synthetic peptide
AASNLQS

SEQ ID NO: 1384 - protein, 9 aa, Artificial Sequence
  Description of Artificial Sequence: Synthetic peptide
QQAQTFPFT

SEQ ID NO: 1385 - protein, 5 aa, Artificial Sequence
  Description of Artificial Sequence: Synthetic peptide
QYPMW

SEQ ID NO: 1386 - protein, 17 aa, Artificial Sequence
  Description of Artificial Sequence: Synthetic peptide
YIVPSGGRTYYADSVKG

SEQ ID NO: 1387 - protein, 15 aa, Artificial Sequence
  Description of Artificial Sequence: Synthetic peptide
DRAYGDYVGWNGFDY

SEQ ID NO: 1388 - protein, 11 aa, Artificial Sequence
  Description of Artificial Sequence: Synthetic peptide
RASQNIGRWLA

SEQ ID NO: 1389 - protein, 7 aa, Artificial Sequence
  Description of Artificial Sequence: Synthetic peptide
GASSLQT

SEQ ID NO: 1390 - protein, 9 aa, Artificial Sequence
  Description of Artificial Sequence: Synthetic peptide
QQRRKWPVT

SEQ ID NO: 1391 - protein, 5 aa, Artificial Sequence
  Description of Artificial Sequence: Synthetic peptide
QYPMW

SEQ ID NO: 1392 - protein, 17 aa, Artificial Sequence
  Description of Artificial Sequence: Synthetic peptide
YIVPSGGRTYYADSVKG

SEQ ID NO: 1393 - protein, 15 aa, Artificial Sequence
  Description of Artificial Sequence: Synthetic peptide
DRAYGDYVGWNGFDY

SEQ ID NO: 1394 - protein, 11 aa, Artificial Sequence
  Description of Artificial Sequence: Synthetic peptide
RASQNIGSDLA

SEQ ID NO: 1395 - protein, 7 aa, Artificial Sequence
  Description of Artificial Sequence: Synthetic peptide
RASFRAT

SEQ ID NO: 1396 - protein, 9 aa, Artificial Sequence
  Description of Artificial Sequence: Synthetic peptide
QQRGNWPPT

SEQ ID NO: 1397 - protein, 5 aa, Artificial Sequence
  Description of Artificial Sequence: Synthetic peptide
QYPMW

SEQ ID NO: 1398 - protein, 17 aa, Artificial Sequence
  Description of Artificial Sequence: Synthetic peptide
YIVPSGGRTYYADSVKG

SEQ ID NO: 1399 - protein, 15 aa, Artificial Sequence
  Description of Artificial Sequence: Synthetic peptide
DRAYGDYVGWNGFDY

SEQ ID NO: 1400 - protein, 11 aa, Artificial Sequence
  Description of Artificial Sequence: Synthetic peptide
RASQSISSFLA

SEQ ID NO: 1401 - protein, 7 aa, Artificial Sequence
  Description of Artificial Sequence: Synthetic peptide
DASYRAT

SEQ ID NO: 1402 - protein, 9 aa, Artificial Sequence
  Description of Artificial Sequence: Synthetic peptide
QQRGNWPIT

SEQ ID NO: 1403 - protein, 5 aa, Artificial Sequence
  Description of Artificial Sequence: Synthetic peptide
QYPMW

SEQ ID NO: 1404 - protein, 17 aa, Artificial Sequence
  Description of Artificial Sequence: Synthetic peptide
YIVPSGGRTYYADSVKG

SEQ ID NO: 1405 - protein, 15 aa, Artificial Sequence
  Description of Artificial Sequence: Synthetic peptide
DRAYGDYVGWNGFDY

SEQ ID NO: 1406 - protein, 11 aa, Artificial Sequence
  Description of Artificial Sequence: Synthetic peptide
RASQSVSSDLA

SEQ ID NO: 1407 - protein, 7 aa, Artificial Sequence
  Description of Artificial Sequence: Synthetic peptide
GASTRAT

SEQ ID NO: 1408 - protein, 9 aa, Artificial Sequence
  Description of Artificial Sequence: Synthetic peptide
QQRSNWPVT

SEQ ID NO: 1409 - protein, 5 aa, Artificial Sequence
  Description of Artificial Sequence: Synthetic peptide
QYPMW

SEQ ID NO: 1410 - protein, 17 aa, Artificial Sequence
  Description of Artificial Sequence: Synthetic peptide
YIVPSGGRTYYADSVKG

SEQ ID NO: 1411 - protein, 15 aa, Artificial Sequence
  Description of Artificial Sequence: Synthetic peptide
DRAYGDYVGWNGFDY

SEQ ID NO: 1412 - protein, 11 aa, Artificial Sequence
  Description of Artificial Sequence: Synthetic peptide
RATQGIGTFLA

SEQ ID NO: 1413 - protein, 7 aa, Artificial Sequence
  Description of Artificial Sequence: Synthetic peptide
GASTLQS

SEQ ID NO: 1414 - protein, 9 aa, Artificial Sequence
  Description of Artificial Sequence: Synthetic peptide
QQRYTWPIT

SEQ ID NO: 1415 - protein, 5 aa, Artificial Sequence
  Description of Artificial Sequence: Synthetic peptide
QYPMW

SEQ ID NO: 1416 - protein, 17 aa, Artificial Sequence
  Description of Artificial Sequence: Synthetic peptide
YIVPSGGRTYYADSVKG

SEQ ID NO: 1417 - protein, 15 aa, Artificial Sequence
  Description of Artificial Sequence: Synthetic peptide
DRAYGDYVGWNGFDY

SEQ ID NO: 1418 - protein, 11 aa, Artificial Sequence
  Description of Artificial Sequence: Synthetic peptide
TASQSVGSHLA

SEQ ID NO: 1419 - protein, 7 aa, Artificial Sequence
  Description of Artificial Sequence: Synthetic peptide
DTSSRAT

SEQ ID NO: 1420 - protein, 9 aa, Artificial Sequence
  Description of Artificial Sequence: Synthetic peptide
QQRRSWPLT

SEQ ID NO: 1421 - protein, 5 aa, Artificial Sequence
  Description of Artificial Sequence: Synthetic peptide
QYPMW

SEQ ID NO: 1422 - protein, 17 aa, Artificial Sequence
  Description of Artificial Sequence: Synthetic peptide
YIVPSGGRTYYADSVKG

SEQ ID NO: 1423 - protein, 15 aa, Artificial Sequence
  Description of Artificial Sequence: Synthetic peptide
DRAYGDYVGWNGFDY

SEQ ID NO: 1424 - protein, 11 aa, Artificial Sequence
  Description of Artificial Sequence: Synthetic peptide
RASQSVSSDLA

SEQ ID NO: 1425 - protein, 7 aa, Artificial Sequence
  Description of Artificial Sequence: Synthetic peptide
GASTRAT

SEQ ID NO: 1426 - protein, 9 aa, Artificial Sequence
  Description of Artificial Sequence: Synthetic peptide
QQRAYWPVS

SEQ ID NO: 1427 - protein, 5 aa, Artificial Sequence
  Description of Artificial Sequence: Synthetic peptide
QYPMW

SEQ ID NO: 1428 - protein, 17 aa, Artificial Sequence
  Description of Artificial Sequence: Synthetic peptide
YIVPSGGRTYYADSVKG

SEQ ID NO: 1429 - protein, 15 aa, Artificial Sequence
  Description of Artificial Sequence: Synthetic peptide
DRAYGDYVGWNGFDY

SEQ ID NO: 1430 - protein, 11 aa, Artificial Sequence
  Description of Artificial Sequence: Synthetic peptide
RASQHIYTSLA

SEQ ID NO: 1431 - protein, 7 aa, Artificial Sequence
  Description of Artificial Sequence: Synthetic peptide
EASYRAT

SEQ ID NO: 1432 - protein, 9 aa, Artificial Sequence
  Description of Artificial Sequence: Synthetic peptide
QQRGSWPIT

SEQ ID NO: 1433 - protein, 5 aa, Artificial Sequence
  Description of Artificial Sequence: Synthetic peptide
QYPMW

SEQ ID NO: 1434 - protein, 17 aa, Artificial Sequence
  Description of Artificial Sequence: Synthetic peptide
YIVPSGGRTYYADSVKG

SEQ ID NO: 1435 - protein, 15 aa, Artificial Sequence
  Description of Artificial Sequence: Synthetic peptide
DRAYGDYVGWNGFDY

SEQ ID NO: 1436 - protein, 11 aa, Artificial Sequence
  Description of Artificial Sequence: Synthetic peptide
RASQSVSSYLA

SEQ ID NO: 1437 - protein, 7 aa, Artificial Sequence
  Description of Artificial Sequence: Synthetic peptide
GASTRAT

SEQ ID NO: 1438 - protein, 9 aa, Artificial Sequence
  Description of Artificial Sequence: Synthetic peptide
QQRGFWPIT

SEQ ID NO: 1439 - protein, 5 aa, Artificial Sequence
  Description of Artificial Sequence: Synthetic peptide
QYPMW

SEQ ID NO: 1440 - protein, 17 aa, Artificial Sequence
  Description of Artificial Sequence: Synthetic peptide
YIVPSGGRTYYADSVKG

SEQ ID NO: 1441 - protein, 15 aa, Artificial Sequence
  Description of Artificial Sequence: Synthetic peptide
DRAYGDYVGWNGFDY

SEQ ID NO: 1442 - protein, 11 aa, Artificial Sequence
  Description of Artificial Sequence: Synthetic peptide
RASQSVSSYLA

SEQ ID NO: 1443 - protein, 7 aa, Artificial Sequence
  Description of Artificial Sequence: Synthetic peptide
GASNRAT

SEQ ID NO: 1444 - protein, 9 aa, Artificial Sequence
  Description of Artificial Sequence: Synthetic peptide
QQRGNWPIT

SEQ ID NO: 1445 - protein, 5 aa, Artificial Sequence
  Description of Artificial Sequence: Synthetic peptide
QYPMW

SEQ ID NO: 1446 - protein, 17 aa, Artificial Sequence
  Description of Artificial Sequence: Synthetic peptide
YIVPSGGRTYYADSVKG

SEQ ID NO: 1447 - protein, 15 aa, Artificial Sequence
  Description of Artificial Sequence: Synthetic peptide
DRAYGDYVGWNGFDY

SEQ ID NO: 1448 - protein, 10 aa, Artificial Sequence
  Description of Artificial Sequence: Synthetic peptide
RASQSVSSVA

SEQ ID NO: 1449 - protein, 7 aa, Artificial Sequence
  Description of Artificial Sequence: Synthetic peptide
DTSNRAT

SEQ ID NO: 1450 - protein, 9 aa, Artificial Sequence
  Description of Artificial Sequence: Synthetic peptide
QQRTKWPIT

SEQ ID NO: 1451 - protein, 5 aa, Artificial Sequence
  Description of Artificial Sequence: Synthetic peptide
QYPMW

SEQ ID NO: 1452 - protein, 17 aa, Artificial Sequence
  Description of Artificial Sequence: Synthetic peptide
YIVPSGGRTYYADSVKG

SEQ ID NO: 1453 - protein, 15 aa, Artificial Sequence
  Description of Artificial Sequence: Synthetic peptide
DRAYGDYVGWNGFDY

SEQ ID NO: 1454 - protein, 11 aa, Artificial Sequence
  Description of Artificial Sequence: Synthetic peptide
RASESVGMYIA

SEQ ID NO: 1455 - protein, 7 aa, Artificial Sequence
  Description of Artificial Sequence: Synthetic peptide
GASNRAT

SEQ ID NO: 1456 - protein, 9 aa, Artificial Sequence
  Description of Artificial Sequence: Synthetic peptide
QQRGNWPIT

SEQ ID NO: 1457 - protein, 5 aa, Artificial Sequence
  Description of Artificial Sequence: Synthetic peptide
QYPMW

SEQ ID NO: 1458 - protein, 17 aa, Artificial Sequence
  Description of Artificial Sequence: Synthetic peptide
YIVPSGGRTYYADSVKG

SEQ ID NO: 1459 - protein, 15 aa, Artificial Sequence
  Description of Artificial Sequence: Synthetic peptide
DRAYGDYVGWNGFDY

SEQ ID NO: 1460 - protein, 12 aa, Artificial Sequence
  Description of Artificial Sequence: Synthetic peptide
GASQSVSSSYLA

SEQ ID NO: 1461 - protein, 7 aa, Artificial Sequence
  Description of Artificial Sequence: Synthetic peptide
DASSRAT

SEQ ID NO: 1462 - protein, 9 aa, Artificial Sequence
  Description of Artificial Sequence: Synthetic peptide
QQYGSSPWT

SEQ ID NO: 1463 - protein, 5 aa, Artificial Sequence
  Description of Artificial Sequence: Synthetic peptide
QYPMW

SEQ ID NO: 1464 - protein, 17 aa, Artificial Sequence
  Description of Artificial Sequence: Synthetic peptide
YIVPSGGRTYYADSVKG

SEQ ID NO: 1465 - protein, 15 aa, Artificial Sequence
  Description of Artificial Sequence: Synthetic peptide
DRAYGDYVGWNGFDY

SEQ ID NO: 1466 - protein, 11 aa, Artificial Sequence
  Description of Artificial Sequence: Synthetic peptide
RASPSISNFLA

SEQ ID NO: 1467 - protein, 7 aa, Artificial Sequence
  Description of Artificial Sequence: Synthetic peptide
GASNRAT

SEQ ID NO: 1468 - protein, 9 aa, Artificial Sequence
  Description of Artificial Sequence: Synthetic peptide
QQRRSWPPT

SEQ ID NO: 1469 - protein, 5 aa, Artificial Sequence
  Description of Artificial Sequence: Synthetic peptide
QYPMW

SEQ ID NO: 1470 - protein, 17 aa, Artificial Sequence
  Description of Artificial Sequence: Synthetic peptide
YIVPSGGRTYYADSVKG

SEQ ID NO: 1471 - protein, 15 aa, Artificial Sequence
  Description of Artificial Sequence: Synthetic peptide
DRAYGDYVGWNGFDY

SEQ ID NO: 1472 - protein, 11 aa, Artificial Sequence
  Description of Artificial Sequence: Synthetic peptide
RASQNIGGYLA

SEQ ID NO: 1473 - protein, 7 aa, Artificial Sequence
  Description of Artificial Sequence: Synthetic peptide
GASNRAT

SEQ ID NO: 1474 - protein, 9 aa, Artificial Sequence
  Description of Artificial Sequence: Synthetic peptide
QQRSNWPPT

SEQ ID NO: 1475 - protein, 5 aa, Artificial Sequence
  Description of Artificial Sequence: Synthetic peptide
QYPMW

SEQ ID NO: 1476 - protein, 17 aa, Artificial Sequence
  Description of Artificial Sequence: Synthetic peptide
YIVPSGGRTYYADSVKG

SEQ ID NO: 1477 - protein, 15 aa, Artificial Sequence
  Description of Artificial Sequence: Synthetic peptide
DRAYGDYVGWNGFDY

SEQ ID NO: 1478 - protein, 11 aa, Artificial Sequence
  Description of Artificial Sequence: Synthetic peptide
RASQNVANYLD

SEQ ID NO: 1479 - protein, 7 aa, Artificial Sequence
  Description of Artificial Sequence: Synthetic peptide
DGSNRAT

SEQ ID NO: 1480 - protein, 10 aa, Artificial Sequence
  Description of Artificial Sequence: Synthetic peptide
QQRHSWPPIT

SEQ ID NO: 1481 - protein, 5 aa, Artificial Sequence
  Description of Artificial Sequence: Synthetic peptide
QYPMW

SEQ ID NO: 1482 - protein, 17 aa, Artificial Sequence
  Description of Artificial Sequence: Synthetic peptide
YIVPSGGRTYYADSVKG

SEQ ID NO: 1483 - protein, 15 aa, Artificial Sequence
  Description of Artificial Sequence: Synthetic peptide
DRAYGDYVGWNGFDY

SEQ ID NO: 1484 - protein, 11 aa, Artificial Sequence
  Description of Artificial Sequence: Synthetic peptide
RASQNVHTYLA

SEQ ID NO: 1485 - protein, 7 aa, Artificial Sequence
  Description of Artificial Sequence: Synthetic peptide
EASNRAT

SEQ ID NO: 1486 - protein, 9 aa, Artificial Sequence
  Description of Artificial Sequence: Synthetic peptide
QQRGGWPIT

SEQ ID NO: 1487 - protein, 5 aa, Artificial Sequence
  Description of Artificial Sequence: Synthetic peptide
QYPMW

SEQ ID NO: 1488 - protein, 17 aa, Artificial Sequence
  Description of Artificial Sequence: Synthetic peptide
YIVPSGGRTYYADSVKG

SEQ ID NO: 1489 - protein, 15 aa, Artificial Sequence
  Description of Artificial Sequence: Synthetic peptide
DRAYGDYVGWNGFDY

SEQ ID NO: 1490 - protein, 11 aa, Artificial Sequence
  Description of Artificial Sequence: Synthetic peptide
RASQSIGNHLA

SEQ ID NO: 1491 - protein, 7 aa, Artificial Sequence
  Description of Artificial Sequence: Synthetic peptide
DASNRAT

SEQ ID NO: 1492 - protein, 9 aa, Artificial Sequence
  Description of Artificial Sequence: Synthetic peptide
QQRGNWPIT

SEQ ID NO: 1493 - protein, 5 aa, Artificial Sequence
  Description of Artificial Sequence: Synthetic peptide
QYPMW

SEQ ID NO: 1494 - protein, 17 aa, Artificial Sequence
  Description of Artificial Sequence: Synthetic peptide
YIVPSGGRTYYADSVKG

SEQ ID NO: 1495 - protein, 15 aa, Artificial Sequence
  Description of Artificial Sequence: Synthetic peptide
DRAYGDYVGWNGFDY

SEQ ID NO: 1496 - protein, 11 aa, Artificial Sequence
  Description of Artificial Sequence: Synthetic peptide
RASQSISSFLA

SEQ ID NO: 1497 - protein, 7 aa, Artificial Sequence
  Description of Artificial Sequence: Synthetic peptide
DASYRAT

SEQ ID NO: 1498 - protein, 9 aa, Artificial Sequence
  Description of Artificial Sequence: Synthetic peptide
QQRGNWPIT

SEQ ID NO: 1499 - protein, 5 aa, Artificial Sequence
  Description of Artificial Sequence: Synthetic peptide
QYPMW

SEQ ID NO: 1500 - protein, 17 aa, Artificial Sequence
  Description of Artificial Sequence: Synthetic peptide
YIVPSGGRTYYADSVKG

SEQ ID NO: 1501 - protein, 15 aa, Artificial Sequence
  Description of Artificial Sequence: Synthetic peptide
DRAYGDYVGWNGFDY

SEQ ID NO: 1502 - protein, 11 aa, Artificial Sequence
  Description of Artificial Sequence: Synthetic peptide
RASQSISSFLA

SEQ ID NO: 1503 - protein, 7 aa, Artificial Sequence
  Description of Artificial Sequence: Synthetic peptide
GASSRAR

SEQ ID NO: 1504 - protein, 9 aa, Artificial Sequence
  Description of Artificial Sequence: Synthetic peptide
QQRGNWPIT

SEQ ID NO: 1505 - protein, 5 aa, Artificial Sequence
  Description of Artificial Sequence: Synthetic peptide
QYPMW

SEQ ID NO: 1506 - protein, 17 aa, Artificial Sequence
  Description of Artificial Sequence: Synthetic peptide
YIVPSGGRTYYADSVKG

SEQ ID NO: 1507 - protein, 15 aa, Artificial Sequence
  Description of Artificial Sequence: Synthetic peptide
DRAYGDYVGWNGFDY

SEQ ID NO: 1508 - protein, 11 aa, Artificial Sequence
  Description of Artificial Sequence: Synthetic peptide
RASQSISSFLA

SEQ ID NO: 1509 - protein, 7 aa, Artificial Sequence
  Description of Artificial Sequence: Synthetic peptide
GASTRAT

SEQ ID NO: 1510 - protein, 9 aa, Artificial Sequence
  Description of Artificial Sequence: Synthetic peptide
QQRGNWPIT

SEQ ID NO: 1511 - protein, 5 aa, Artificial Sequence
  Description of Artificial Sequence: Synthetic peptide
QYPMW

SEQ ID NO: 1512 - protein, 17 aa, Artificial Sequence
  Description of Artificial Sequence: Synthetic peptide
YIVPSGGRTYYADSVKG

SEQ ID NO: 1513 - protein, 15 aa, Artificial Sequence
  Description of Artificial Sequence: Synthetic peptide
DRAYGDYVGWNGFDY

SEQ ID NO: 1514 - protein, 11 aa, Artificial Sequence
  Description of Artificial Sequence: Synthetic peptide
RASQSISSHLA

SEQ ID NO: 1515 - protein, 7 aa, Artificial Sequence
  Description of Artificial Sequence: Synthetic peptide
GASSRAT

SEQ ID NO: 1516 - protein, 9 aa, Artificial Sequence
  Description of Artificial Sequence: Synthetic peptide
QQRGNWPIT

SEQ ID NO: 1517 - protein, 5 aa, Artificial Sequence
  Description of Artificial Sequence: Synthetic peptide
QYPMW

SEQ ID NO: 1518 - protein, 17 aa, Artificial Sequence
  Description of Artificial Sequence: Synthetic peptide
YIVPSGGRTYYADSVKG

SEQ ID NO: 1519 - protein, 15 aa, Artificial Sequence
  Description of Artificial Sequence: Synthetic peptide
DRAYGDYVGWNGFDY

SEQ ID NO: 1520 - protein, 11 aa, Artificial Sequence
  Description of Artificial Sequence: Synthetic peptide
RASQSISTSLA

SEQ ID NO: 1521 - protein, 6 aa, Artificial Sequence
  Description of Artificial Sequence: Synthetic peptide
DASNRA

SEQ ID NO: 1522 - protein, 9 aa, Artificial Sequence
  Description of Artificial Sequence: Synthetic peptide
QQRGAWPLT

SEQ ID NO: 1523 - protein, 5 aa, Artificial Sequence
  Description of Artificial Sequence: Synthetic peptide
QYPMW

SEQ ID NO: 1524 - protein, 17 aa, Artificial Sequence
  Description of Artificial Sequence: Synthetic peptide
YIVPSGGRTYYADSVKG

SEQ ID NO: 1525 - protein, 15 aa, Artificial Sequence
  Description of Artificial Sequence: Synthetic peptide
DRAYGDYVGWNGFDY

SEQ ID NO: 1526 - protein, 12 aa, Artificial Sequence
  Description of Artificial Sequence: Synthetic peptide
RASQSLGRSDLA

SEQ ID NO: 1527 - protein, 7 aa, Artificial Sequence
  Description of Artificial Sequence: Synthetic peptide
GVSNRVT

SEQ ID NO: 1528 - protein, 9 aa, Artificial Sequence
  Description of Artificial Sequence: Synthetic peptide
QQRSNWPPT

SEQ ID NO: 1529 - protein, 5 aa, Artificial Sequence
  Description of Artificial Sequence: Synthetic peptide
QYPMW

SEQ ID NO: 1530 - protein, 17 aa, Artificial Sequence
  Description of Artificial Sequence: Synthetic peptide
YIVPSGGRTYYADSVKG

SEQ ID NO: 1531 - protein, 15 aa, Artificial Sequence
  Description of Artificial Sequence: Synthetic peptide
DRAYGDYVGWNGFDY

SEQ ID NO: 1532 - protein, 12 aa, Artificial Sequence
  Description of Artificial Sequence: Synthetic peptide
RASQSLGRSDLA

SEQ ID NO: 1533 - protein, 7 aa, Artificial Sequence
  Description of Artificial Sequence: Synthetic peptide
GVSNRVT

SEQ ID NO: 1534 - protein, 9 aa, Artificial Sequence
  Description of Artificial Sequence: Synthetic peptide
QQRSTWPIT

SEQ ID NO: 1535 - protein, 5 aa, Artificial Sequence
  Description of Artificial Sequence: Synthetic peptide
QYPMW

SEQ ID NO: 1536 - protein, 17 aa, Artificial Sequence
  Description of Artificial Sequence: Synthetic peptide
YIVPSGGRTYYADSVKG

SEQ ID NO: 1537 - protein, 15 aa, Artificial Sequence
  Description of Artificial Sequence: Synthetic peptide
DRAYGDYVGWNGFDY

SEQ ID NO: 1538 - protein, 11 aa, Artificial Sequence
  Description of Artificial Sequence: Synthetic peptide
RASQSLGSFLA

SEQ ID NO: 1539 - protein, 7 aa, Artificial Sequence
  Description of Artificial Sequence: Synthetic peptide
GASYRAT

SEQ ID NO: 1540 - protein, 9 aa, Artificial Sequence
  Description of Artificial Sequence: Synthetic peptide
QQRGNWPIT

SEQ ID NO: 1541 - protein, 5 aa, Artificial Sequence
  Description of Artificial Sequence: Synthetic peptide
QYPMW

SEQ ID NO: 1542 - protein, 17 aa, Artificial Sequence
  Description of Artificial Sequence: Synthetic peptide
YIVPSGGRTYYADSVKG

SEQ ID NO: 1543 - protein, 15 aa, Artificial Sequence
  Description of Artificial Sequence: Synthetic peptide
DRAYGDYVGWNGFDY

SEQ ID NO: 1544 - protein, 11 aa, Artificial Sequence
  Description of Artificial Sequence: Synthetic peptide
RASQSVDSYLA

SEQ ID NO: 1545 - protein, 7 aa, Artificial Sequence
  Description of Artificial Sequence: Synthetic peptide
DASNRAT

SEQ ID NO: 1546 - protein, 9 aa, Artificial Sequence
  Description of Artificial Sequence: Synthetic peptide
QHRRSWPLT

SEQ ID NO: 1547 - protein, 5 aa, Artificial Sequence
  Description of Artificial Sequence: Synthetic peptide
QYPMW

SEQ ID NO: 1548 - protein, 17 aa, Artificial Sequence
  Description of Artificial Sequence: Synthetic peptide
YIVPSGGRTYYADSVKG

SEQ ID NO: 1549 - protein, 15 aa, Artificial Sequence
  Description of Artificial Sequence: Synthetic peptide
DRAYGDYVGWNGFDY

SEQ ID NO: 1550 - protein, 11 aa, Artificial Sequence
  Description of Artificial Sequence: Synthetic peptide
RASQSVDSYLA

SEQ ID NO: 1551 - protein, 7 aa, Artificial Sequence
  Description of Artificial Sequence: Synthetic peptide
GASNRAT

SEQ ID NO: 1552 - protein, 9 aa, Artificial Sequence
  Description of Artificial Sequence: Synthetic peptide
QQRRKWPVT

SEQ ID NO: 1553 - protein, 5 aa, Artificial Sequence
  Description of Artificial Sequence: Synthetic peptide
QYPMW

SEQ ID NO: 1554 - protein, 17 aa, Artificial Sequence
  Description of Artificial Sequence: Synthetic peptide
YIVPSGGRTYYADSVKG

SEQ ID NO: 1555 - protein, 15 aa, Artificial Sequence
  Description of Artificial Sequence: Synthetic peptide
DRAYGDYVGWNGFDY

SEQ ID NO: 1556 - protein, 11 aa, Artificial Sequence
  Description of Artificial Sequence: Synthetic peptide
RASQSVGGDIA

SEQ ID NO: 1557 - protein, 7 aa, Artificial Sequence
  Description of Artificial Sequence: Synthetic peptide
GASNRAT

SEQ ID NO: 1558 - protein, 9 aa, Artificial Sequence
  Description of Artificial Sequence: Synthetic peptide
QQRSYWPVT

SEQ ID NO: 1559 - protein, 5 aa, Artificial Sequence
  Description of Artificial Sequence: Synthetic peptide
QYPMW

SEQ ID NO: 1560 - protein, 17 aa, Artificial Sequence
  Description of Artificial Sequence: Synthetic peptide
YIVPSGGRTYYADSVKG

SEQ ID NO: 1561 - protein, 15 aa, Artificial Sequence
  Description of Artificial Sequence: Synthetic peptide
DRAYGDYVGWNGFDY

SEQ ID NO: 1562 - protein, 11 aa, Artificial Sequence
  Description of Artificial Sequence: Synthetic peptide
RASQSVGRDLA

SEQ ID NO: 1563 - protein, 7 aa, Artificial Sequence
  Description of Artificial Sequence: Synthetic peptide
GATTRAT

SEQ ID NO: 1564 - protein, 9 aa, Artificial Sequence
  Description of Artificial Sequence: Synthetic peptide
QQRGNWPIT

SEQ ID NO: 1565 - protein, 5 aa, Artificial Sequence
  Description of Artificial Sequence: Synthetic peptide
QYPMW

SEQ ID NO: 1566 - protein, 17 aa, Artificial Sequence
  Description of Artificial Sequence: Synthetic peptide
YIVPSGGRTYYADSVKG

SEQ ID NO: 1567 - protein, 15 aa, Artificial Sequence
  Description of Artificial Sequence: Synthetic peptide
DRAYGDYVGWNGFDY

SEQ ID NO: 1568 - protein, 11 aa, Artificial Sequence
  Description of Artificial Sequence: Synthetic peptide
RASQSVGSDLA

SEQ ID NO: 1569 - protein, 7 aa, Artificial Sequence
  Description of Artificial Sequence: Synthetic peptide
GASTRAT

SEQ ID NO: 1570 - protein, 9 aa, Artificial Sequence
  Description of Artificial Sequence: Synthetic peptide
QQRGNWPIT

SEQ ID NO: 1571 - protein, 5 aa, Artificial Sequence
  Description of Artificial Sequence: Synthetic peptide
QYPMW

SEQ ID NO: 1572 - protein, 17 aa, Artificial Sequence
  Description of Artificial Sequence: Synthetic peptide
YIVPSGGRTYYADSVKG

SEQ ID NO: 1573 - protein, 15 aa, Artificial Sequence
  Description of Artificial Sequence: Synthetic peptide
DRAYGDYVGWNGFDY

SEQ ID NO: 1574 - protein, 11 aa, Artificial Sequence
  Description of Artificial Sequence: Synthetic peptide
RASQSVGSFLA

SEQ ID NO: 1575 - protein, 7 aa, Artificial Sequence
  Description of Artificial Sequence: Synthetic peptide
GASNRAT

SEQ ID NO: 1576 - protein, 9 aa, Artificial Sequence
  Description of Artificial Sequence: Synthetic peptide
QQRGNWPIT

SEQ ID NO: 1577 - protein, 5 aa, Artificial Sequence
  Description of Artificial Sequence: Synthetic peptide
QYPMW

SEQ ID NO: 1578 - protein, 17 aa, Artificial Sequence
  Description of Artificial Sequence: Synthetic peptide
YIVPSGGRTYYADSVKG

SEQ ID NO: 1579 - protein, 15 aa, Artificial Sequence
  Description of Artificial Sequence: Synthetic peptide
DRAYGDYVGWNGFDY

SEQ ID NO: 1580 - protein, 11 aa, Artificial Sequence
  Description of Artificial Sequence: Synthetic peptide
RASQSVGSQLA

SEQ ID NO: 1581 - protein, 7 aa, Artificial Sequence
  Description of Artificial Sequence: Synthetic peptide
DASYRAT

SEQ ID NO: 1582 - protein, 9 aa, Artificial Sequence
  Description of Artificial Sequence: Synthetic peptide
QQRGNWPIT

SEQ ID NO: 1583 - protein, 5 aa, Artificial Sequence
  Description of Artificial Sequence: Synthetic peptide
QYPMW

SEQ ID NO: 1584 - protein, 17 aa, Artificial Sequence
  Description of Artificial Sequence: Synthetic peptide
YIVPSGGRTYYADSVKG

SEQ ID NO: 1585 - protein, 15 aa, Artificial Sequence
  Description of Artificial Sequence: Synthetic peptide
DRAYGDYVGWNGFDY

SEQ ID NO: 1586 - protein, 11 aa, Artificial Sequence
  Description of Artificial Sequence: Synthetic peptide
RASQSVGTHLA

SEQ ID NO: 1587 - protein, 7 aa, Artificial Sequence
  Description of Artificial Sequence: Synthetic peptide
GASTRAT

SEQ ID NO: 1588 - protein, 9 aa, Artificial Sequence
  Description of Artificial Sequence: Synthetic peptide
QQRRSWPIT

SEQ ID NO: 1589 - protein, 5 aa, Artificial Sequence
  Description of Artificial Sequence: Synthetic peptide
QYPMW

SEQ ID NO: 1590 - protein, 17 aa, Artificial Sequence
  Description of Artificial Sequence: Synthetic peptide
YIVPSGGRTYYADSVKG

SEQ ID NO: 1591 - protein, 15 aa, Artificial Sequence
  Description of Artificial Sequence: Synthetic peptide
DRAYGDYVGWNGFDY

SEQ ID NO: 1592 - protein, 11 aa, Artificial Sequence
  Description of Artificial Sequence: Synthetic peptide
RASQSVNHFLA

SEQ ID NO: 1593 - protein, 7 aa, Artificial Sequence
  Description of Artificial Sequence: Synthetic peptide
GASNRAT

SEQ ID NO: 1594 - protein, 9 aa, Artificial Sequence
  Description of Artificial Sequence: Synthetic peptide
QQRGSWPIT

SEQ ID NO: 1595 - protein, 5 aa, Artificial Sequence
  Description of Artificial Sequence: Synthetic peptide
QYPMW

SEQ ID NO: 1596 - protein, 17 aa, Artificial Sequence
  Description of Artificial Sequence: Synthetic peptide
YIVPSGGRTYYADSVKG

SEQ ID NO: 1597 - protein, 15 aa, Artificial Sequence
  Description of Artificial Sequence: Synthetic peptide
DRAYGDYVGWNGFDY

SEQ ID NO: 1598 - protein, 11 aa, Artificial Sequence
  Description of Artificial Sequence: Synthetic peptide
RASQSVNSFLA

SEQ ID NO: 1599 - protein, 7 aa, Artificial Sequence
  Description of Artificial Sequence: Synthetic peptide
DASNRAT

SEQ ID NO: 1600 - protein, 9 aa, Artificial Sequence
  Description of Artificial Sequence: Synthetic peptide
QQRSNWPIT

SEQ ID NO: 1601 - protein, 5 aa, Artificial Sequence
  Description of Artificial Sequence: Synthetic peptide
QYPMW

SEQ ID NO: 1602 - protein, 17 aa, Artificial Sequence
  Description of Artificial Sequence: Synthetic peptide
YIVPSGGRTYYADSVKG

SEQ ID NO: 1603 - protein, 15 aa, Artificial Sequence
  Description of Artificial Sequence: Synthetic peptide
DRAYGDYVGWNGFDY

SEQ ID NO: 1604 - protein, 11 aa, Artificial Sequence
  Description of Artificial Sequence: Synthetic peptide
RASQSVNSYLA

SEQ ID NO: 1605 - protein, 7 aa, Artificial Sequence
  Description of Artificial Sequence: Synthetic peptide
DASNRAT

SEQ ID NO: 1606 - protein, 9 aa, Artificial Sequence
  Description of Artificial Sequence: Synthetic peptide
QQRGYWPPS

SEQ ID NO: 1607 - protein, 5 aa, Artificial Sequence
  Description of Artificial Sequence: Synthetic peptide
QYPMW

SEQ ID NO: 1608 - protein, 17 aa, Artificial Sequence
  Description of Artificial Sequence: Synthetic peptide
YIVPSGGRTYYADSVKG

SEQ ID NO: 1609 - protein, 15 aa, Artificial Sequence
  Description of Artificial Sequence: Synthetic peptide
DRAYGDYVGWNGFDY

SEQ ID NO: 1610 - protein, 11 aa, Artificial Sequence
  Description of Artificial Sequence: Synthetic peptide
RASQSVSNFLA

SEQ ID NO: 1611 - protein, 7 aa, Artificial Sequence
  Description of Artificial Sequence: Synthetic peptide
GASSRAT

SEQ ID NO: 1612 - protein, 9 aa, Artificial Sequence
  Description of Artificial Sequence: Synthetic peptide
QQRGNWPIT

SEQ ID NO: 1613 - protein, 5 aa, Artificial Sequence
  Description of Artificial Sequence: Synthetic peptide
QYPMW

SEQ ID NO: 1614 - protein, 17 aa, Artificial Sequence
  Description of Artificial Sequence: Synthetic peptide
YIVPSGGRTYYADSVKG

SEQ ID NO: 1615 - protein, 15 aa, Artificial Sequence
  Description of Artificial Sequence: Synthetic peptide
DRAYGDYVGWNGFDY

SEQ ID NO: 1616 - protein, 11 aa, Artificial Sequence
  Description of Artificial Sequence: Synthetic peptide
RASQSVSNYLA

SEQ ID NO: 1617 - protein, 7 aa, Artificial Sequence
  Description of Artificial Sequence: Synthetic peptide
GASTRAT

SEQ ID NO: 1618 - protein, 9 aa, Artificial Sequence
  Description of Artificial Sequence: Synthetic peptide
QQRGNWPIT

SEQ ID NO: 1619 - protein, 5 aa, Artificial Sequence
  Description of Artificial Sequence: Synthetic peptide
QYPMW

SEQ ID NO: 1620 - protein, 17 aa, Artificial Sequence
  Description of Artificial Sequence: Synthetic peptide
YIVPSGGRTYYADSVKG

SEQ ID NO: 1621 - protein, 15 aa, Artificial Sequence
  Description of Artificial Sequence: Synthetic peptide
DRAYGDYVGWNGFDY

SEQ ID NO: 1622 - protein, 11 aa, Artificial Sequence
  Description of Artificial Sequence: Synthetic peptide
RASQSVSRYLA

SEQ ID NO: 1623 - protein, 7 aa, Artificial Sequence
  Description of Artificial Sequence: Synthetic peptide
DASSRAT

SEQ ID NO: 1624 - protein, 9 aa, Artificial Sequence
  Description of Artificial Sequence: Synthetic peptide
HQRSSWPIT

SEQ ID NO: 1625 - protein, 5 aa, Artificial Sequence
  Description of Artificial Sequence: Synthetic peptide
QYPMW

SEQ ID NO: 1626 - protein, 17 aa, Artificial Sequence
  Description of Artificial Sequence: Synthetic peptide
YIVPSGGRTYYADSVKG

SEQ ID NO: 1627 - protein, 15 aa, Artificial Sequence
  Description of Artificial Sequence: Synthetic peptide
DRAYGDYVGWNGFDY

SEQ ID NO: 1628 - protein, 11 aa, Artificial Sequence
  Description of Artificial Sequence: Synthetic peptide
RASQSVSRYLA

SEQ ID NO: 1629 - protein, 7 aa, Artificial Sequence
  Description of Artificial Sequence: Synthetic peptide
DASNRAT

SEQ ID NO: 1630 - protein, 9 aa, Artificial Sequence
  Description of Artificial Sequence: Synthetic peptide
QQRINWPLT

SEQ ID NO: 1631 - protein, 5 aa, Artificial Sequence
  Description of Artificial Sequence: Synthetic peptide
QYPMW

SEQ ID NO: 1632 - protein, 17 aa, Artificial Sequence
  Description of Artificial Sequence: Synthetic peptide
YIVPSGGRTYYADSVKG

SEQ ID NO: 1633 - protein, 15 aa, Artificial Sequence
  Description of Artificial Sequence: Synthetic peptide
DRAYGDYVGWNGFDY

SEQ ID NO: 1634 - protein, 11 aa, Artificial Sequence
  Description of Artificial Sequence: Synthetic peptide
RASQSVSSFLA

SEQ ID NO: 1635 - protein, 7 aa, Artificial Sequence
  Description of Artificial Sequence: Synthetic peptide
HASNRAT

SEQ ID NO: 1636 - protein, 9 aa, Artificial Sequence
  Description of Artificial Sequence: Synthetic peptide
QQRGNWPIT

SEQ ID NO: 1637 - protein, 5 aa, Artificial Sequence
  Description of Artificial Sequence: Synthetic peptide
QYPMW

SEQ ID NO: 1638 - protein, 17 aa, Artificial Sequence
  Description of Artificial Sequence: Synthetic peptide
YIVPSGGRTYYADSVKG

SEQ ID NO: 1639 - protein, 15 aa, Artificial Sequence
  Description of Artificial Sequence: Synthetic peptide
DRAYGDYVGWNGFDY

SEQ ID NO: 1640 - protein, 11 aa, Artificial Sequence
  Description of Artificial Sequence: Synthetic peptide
RASQSVSSFLA

SEQ ID NO: 1641 - protein, 7 aa, Artificial Sequence
  Description of Artificial Sequence: Synthetic peptide
DASNRAS

SEQ ID NO: 1642 - protein, 9 aa, Artificial Sequence
  Description of Artificial Sequence: Synthetic peptide
QQRANWPLT

SEQ ID NO: 1643 - protein, 5 aa, Artificial Sequence
  Description of Artificial Sequence: Synthetic peptide
QYPMW

SEQ ID NO: 1644 - protein, 17 aa, Artificial Sequence
  Description of Artificial Sequence: Synthetic peptide
YIVPSGGRTYYADSVKG

SEQ ID NO: 1645 - protein, 15 aa, Artificial Sequence
  Description of Artificial Sequence: Synthetic peptide
DRAYGDYVGWNGFDY

SEQ ID NO: 1646 - protein, 11 aa, Artificial Sequence
  Description of Artificial Sequence: Synthetic peptide
RASQSVSSHLA

SEQ ID NO: 1647 - protein, 7 aa, Artificial Sequence
  Description of Artificial Sequence: Synthetic peptide
GASSRAT

SEQ ID NO: 1648 - protein, 9 aa, Artificial Sequence
  Description of Artificial Sequence: Synthetic peptide
QQRGNWPIT

SEQ ID NO: 1649 - protein, 5 aa, Artificial Sequence
  Description of Artificial Sequence: Synthetic peptide
QYPMW

SEQ ID NO: 1650 - protein, 17 aa, Artificial Sequence
  Description of Artificial Sequence: Synthetic peptide
YIVPSGGRTYYADSVKG

SEQ ID NO: 1651 - protein, 15 aa, Artificial Sequence
  Description of Artificial Sequence: Synthetic peptide
DRAYGDYVGWNGFDY

SEQ ID NO: 1652 - protein, 11 aa, Artificial Sequence
  Description of Artificial Sequence: Synthetic peptide
RASQSVSSYLA

SEQ ID NO: 1653 - protein, 7 aa, Artificial Sequence
  Description of Artificial Sequence: Synthetic peptide
DASNRAT

SEQ ID NO: 1654 - protein, 9 aa, Artificial Sequence
  Description of Artificial Sequence: Synthetic peptide
QQRGNWPIT

SEQ ID NO: 1655 - protein, 5 aa, Artificial Sequence
  Description of Artificial Sequence: Synthetic peptide
QYPMW

SEQ ID NO: 1656 - protein, 17 aa, Artificial Sequence
  Description of Artificial Sequence: Synthetic peptide
YIVPSGGRTYYADSVKG

SEQ ID NO: 1657 - protein, 15 aa, Artificial Sequence
  Description of Artificial Sequence: Synthetic peptide
DRAYGDYVGWNGFDY

SEQ ID NO: 1658 - protein, 11 aa, Artificial Sequence
  Description of Artificial Sequence: Synthetic peptide
RASQSVSSYLA

SEQ ID NO: 1659 - protein, 7 aa, Artificial Sequence
  Description of Artificial Sequence: Synthetic peptide
GASNRAT

SEQ ID NO: 1660 - protein, 9 aa, Artificial Sequence
  Description of Artificial Sequence: Synthetic peptide
QQRGNWPIT

SEQ ID NO: 1661 - protein, 5 aa, Artificial Sequence
  Description of Artificial Sequence: Synthetic peptide
QYPMW

SEQ ID NO: 1662 - protein, 17 aa, Artificial Sequence
  Description of Artificial Sequence: Synthetic peptide
YIVPSGGRTYYADSVKG

SEQ ID NO: 1663 - protein, 15 aa, Artificial Sequence
  Description of Artificial Sequence: Synthetic peptide
DRAYGDYVGWNGFDY

SEQ ID NO: 1664 - protein, 11 aa, Artificial Sequence
  Description of Artificial Sequence: Synthetic peptide
RASQSVSSYLA

SEQ ID NO: 1665 - protein, 7 aa, Artificial Sequence
  Description of Artificial Sequence: Synthetic peptide
GASHRAT

SEQ ID NO: 1666 - protein, 9 aa, Artificial Sequence
  Description of Artificial Sequence: Synthetic peptide
QQRSNWPIT

SEQ ID NO: 1667 - protein, 5 aa, Artificial Sequence
  Description of Artificial Sequence: Synthetic peptide
QYPMW

SEQ ID NO: 1668 - protein, 17 aa, Artificial Sequence
  Description of Artificial Sequence: Synthetic peptide
YIVPSGGRTYYADSVKG

SEQ ID NO: 1669 - protein, 15 aa, Artificial Sequence
  Description of Artificial Sequence: Synthetic peptide
DRAYGDYVGWNGFDY

SEQ ID NO: 1670 - protein, 11 aa, Artificial Sequence
  Description of Artificial Sequence: Synthetic peptide
RASQSVSSYLA

SEQ ID NO: 1671 - protein, 7 aa, Artificial Sequence
  Description of Artificial Sequence: Synthetic peptide
DASNRAT

SEQ ID NO: 1672 - protein, 9 aa, Artificial Sequence
  Description of Artificial Sequence: Synthetic peptide
QQRGNWPIT

SEQ ID NO: 1673 - protein, 5 aa, Artificial Sequence
  Description of Artificial Sequence: Synthetic peptide
QYPMW

SEQ ID NO: 1674 - protein, 17 aa, Artificial Sequence
  Description of Artificial Sequence: Synthetic peptide
YIVPSGGRTYYADSVKG

SEQ ID NO: 1675 - protein, 15 aa, Artificial Sequence
  Description of Artificial Sequence: Synthetic peptide
DRAYGDYVGWNGFDY

SEQ ID NO: 1676 - protein, 11 aa, Artificial Sequence
  Description of Artificial Sequence: Synthetic peptide
RASQSVSSYLA

SEQ ID NO: 1677 - protein, 7 aa, Artificial Sequence
  Description of Artificial Sequence: Synthetic peptide
DASNRAT

SEQ ID NO: 1678 - protein, 9 aa, Artificial Sequence
  Description of Artificial Sequence: Synthetic peptide
QQRSNWPTT

SEQ ID NO: 1679 - protein, 5 aa, Artificial Sequence
  Description of Artificial Sequence: Synthetic peptide
QYPMW

SEQ ID NO: 1680 - protein, 17 aa, Artificial Sequence
  Description of Artificial Sequence: Synthetic peptide
YIVPSGGRTYYADSVKG

SEQ ID NO: 1681 - protein, 15 aa, Artificial Sequence
  Description of Artificial Sequence: Synthetic peptide
DRAYGDYVGWNGFDY

SEQ ID NO: 1682 - protein, 11 aa, Artificial Sequence
  Description of Artificial Sequence: Synthetic peptide
RASQSVSSYLA

SEQ ID NO: 1683 - protein, 7 aa, Artificial Sequence
  Description of Artificial Sequence: Synthetic peptide
DASNRAT

SEQ ID NO: 1684 - protein, 9 aa, Artificial Sequence
  Description of Artificial Sequence: Synthetic peptide
QQRGNWPIT

SEQ ID NO: 1685 - protein, 5 aa, Artificial Sequence
  Description of Artificial Sequence: Synthetic peptide
QYPMW

SEQ ID NO: 1686 - protein, 17 aa, Artificial Sequence
  Description of Artificial Sequence: Synthetic peptide
YIVPSGGRTYYADSVKG

SEQ ID NO: 1687 - protein, 15 aa, Artificial Sequence
  Description of Artificial Sequence: Synthetic peptide
DRAYGDYVGWNGFDY

SEQ ID NO: 1688 - protein, 11 aa, Artificial Sequence
  Description of Artificial Sequence: Synthetic peptide
RASQSVSSYLA

SEQ ID NO: 1689 - protein, 7 aa, Artificial Sequence
  Description of Artificial Sequence: Synthetic peptide
GASNRAT

SEQ ID NO: 1690 - protein, 9 aa, Artificial Sequence
  Description of Artificial Sequence: Synthetic peptide
QQRSNWPIT

SEQ ID NO: 1691 - protein, 5 aa, Artificial Sequence
  Description of Artificial Sequence: Synthetic peptide
QYPMW

SEQ ID NO: 1692 - protein, 17 aa, Artificial Sequence
  Description of Artificial Sequence: Synthetic peptide
YIVPSGGRTYYADSVKG

SEQ ID NO: 1693 - protein, 15 aa, Artificial Sequence
  Description of Artificial Sequence: Synthetic peptide
DRAYGDYVGWNGFDY

SEQ ID NO: 1694 - protein, 11 aa, Artificial Sequence
  Description of Artificial Sequence: Synthetic peptide
RASQSVSSYLA

SEQ ID NO: 1695 - protein, 7 aa, Artificial Sequence
  Description of Artificial Sequence: Synthetic peptide
GASSRAT

SEQ ID NO: 1696 - protein, 9 aa, Artificial Sequence
  Description of Artificial Sequence: Synthetic peptide
QQRSNWPVT

SEQ ID NO: 1697 - protein, 5 aa, Artificial Sequence
  Description of Artificial Sequence: Synthetic peptide
QYPMW

SEQ ID NO: 1698 - protein, 17 aa, Artificial Sequence
  Description of Artificial Sequence: Synthetic peptide
YIVPSGGRTYYADSVKG

SEQ ID NO: 1699 - protein, 15 aa, Artificial Sequence
  Description of Artificial Sequence: Synthetic peptide
DRAYGDYVGWNGFDY

SEQ ID NO: 1700 - protein, 11 aa, Artificial Sequence
  Description of Artificial Sequence: Synthetic peptide
RASQSVSSYLA

SEQ ID NO: 1701 - protein, 7 aa, Artificial Sequence
  Description of Artificial Sequence: Synthetic peptide
GASTRAT

SEQ ID NO: 1702 - protein, 9 aa, Artificial Sequence
  Description of Artificial Sequence: Synthetic peptide
QQRGNWPIT

SEQ ID NO: 1703 - protein, 5 aa, Artificial Sequence
  Description of Artificial Sequence: Synthetic peptide
QYPMW

SEQ ID NO: 1704 - protein, 17 aa, Artificial Sequence
  Description of Artificial Sequence: Synthetic peptide
YIVPSGGRTYYADSVKG

SEQ ID NO: 1705 - protein, 15 aa, Artificial Sequence
  Description of Artificial Sequence: Synthetic peptide
DRAYGDYVGWNGFDY

SEQ ID NO: 1706 - protein, 11 aa, Artificial Sequence
  Description of Artificial Sequence: Synthetic peptide
RASQSVSSYLA

SEQ ID NO: 1707 - protein, 7 aa, Artificial Sequence
  Description of Artificial Sequence: Synthetic peptide
GASNRAT

SEQ ID NO: 1708 - protein, 9 aa, Artificial Sequence
  Description of Artificial Sequence: Synthetic peptide
QQRGNWPPT

SEQ ID NO: 1709 - protein, 5 aa, Artificial Sequence
  Description of Artificial Sequence: Synthetic peptide
QYPMW

SEQ ID NO: 1710 - protein, 17 aa, Artificial Sequence
  Description of Artificial Sequence: Synthetic peptide
YIVPSGGRTYYADSVKG

SEQ ID NO: 1711 - protein, 15 aa, Artificial Sequence
  Description of Artificial Sequence: Synthetic peptide
DRAYGDYVGWNGFDY

SEQ ID NO: 1712 - protein, 11 aa, Artificial Sequence
  Description of Artificial Sequence: Synthetic peptide
RASQSVSSYLA

SEQ ID NO: 1713 - protein, 7 aa, Artificial Sequence
  Description of Artificial Sequence: Synthetic peptide
GASNRAT

SEQ ID NO: 1714 - protein, 9 aa, Artificial Sequence
  Description of Artificial Sequence: Synthetic peptide
EQRRSWPLT

SEQ ID NO: 1715 - protein, 5 aa, Artificial Sequence
  Description of Artificial Sequence: Synthetic peptide
QYPMW

SEQ ID NO: 1716 - protein, 17 aa, Artificial Sequence
  Description of Artificial Sequence: Synthetic peptide
YIVPSGGRTYYADSVKG

SEQ ID NO: 1717 - protein, 15 aa, Artificial Sequence
  Description of Artificial Sequence: Synthetic peptide
DRAYGDYVGWNGFDY

SEQ ID NO: 1718 - protein, 11 aa, Artificial Sequence
  Description of Artificial Sequence: Synthetic peptide
RASRSVGTHLA

SEQ ID NO: 1719 - protein, 7 aa, Artificial Sequence
  Description of Artificial Sequence: Synthetic peptide
DASVRAA

SEQ ID NO: 1720 - protein, 9 aa, Artificial Sequence
  Description of Artificial Sequence: Synthetic peptide
QQRGGWPIT

SEQ ID NO: 1721 - protein, 5 aa, Artificial Sequence
  Description of Artificial Sequence: Synthetic peptide
QYPMW

SEQ ID NO: 1722 - protein, 17 aa, Artificial Sequence
  Description of Artificial Sequence: Synthetic peptide
YIVPSGGRTYYADSVKG

SEQ ID NO: 1723 - protein, 15 aa, Artificial Sequence
  Description of Artificial Sequence: Synthetic peptide
DRAYGDYVGWNGFDY

SEQ ID NO: 1724 - protein, 11 aa, Artificial Sequence
  Description of Artificial Sequence: Synthetic peptide
RASRSVGTHLA

SEQ ID NO: 1725 - protein, 7 aa, Artificial Sequence
  Description of Artificial Sequence: Synthetic peptide
DASVRAA

SEQ ID NO: 1726 - protein, 9 aa, Artificial Sequence
  Description of Artificial Sequence: Synthetic peptide
QQRGNWPIT

SEQ ID NO: 1727 - protein, 5 aa, Artificial Sequence
  Description of Artificial Sequence: Synthetic peptide
QYPMW

SEQ ID NO: 1728 - protein, 17 aa, Artificial Sequence
  Description of Artificial Sequence: Synthetic peptide
YIVPSGGRTYYADSVKG

SEQ ID NO: 1729 - protein, 15 aa, Artificial Sequence
  Description of Artificial Sequence: Synthetic peptide
DRAYGDYVGWNGFDY

SEQ ID NO: 1730 - protein, 11 aa, Artificial Sequence
  Description of Artificial Sequence: Synthetic peptide
RTSQSVSRYLA

SEQ ID NO: 1731 - protein, 7 aa, Artificial Sequence
  Description of Artificial Sequence: Synthetic peptide
GTSNRAT

SEQ ID NO: 1732 - protein, 9 aa, Artificial Sequence
  Description of Artificial Sequence: Synthetic peptide
QQRYNWPIT

SEQ ID NO: 1733 - protein, 5 aa, Artificial Sequence
  Description of Artificial Sequence: Synthetic peptide
QYPMW

SEQ ID NO: 1734 - protein, 17 aa, Artificial Sequence
  Description of Artificial Sequence: Synthetic peptide
YIVPSGGRTYYADSVKG

SEQ ID NO: 1735 - protein, 15 aa, Artificial Sequence
  Description of Artificial Sequence: Synthetic peptide
DRAYGDYVGWNGFDY

SEQ ID NO: 1736 - protein, 11 aa, Artificial Sequence
  Description of Artificial Sequence: Synthetic peptide
RTSQSVSRYLA

SEQ ID NO: 1737 - protein, 7 aa, Artificial Sequence
  Description of Artificial Sequence: Synthetic peptide
GTSNRAT

SEQ ID NO: 1738 - protein, 9 aa, Artificial Sequence
  Description of Artificial Sequence: Synthetic peptide
QQRYNWPIT

SEQ ID NO: 1739 - protein, 5 aa, Artificial Sequence
  Description of Artificial Sequence: Synthetic peptide
QYPMW

SEQ ID NO: 1740 - protein, 17 aa, Artificial Sequence
  Description of Artificial Sequence: Synthetic peptide
YIVPSGGRTYYADSVKG

SEQ ID NO: 1741 - protein, 15 aa, Artificial Sequence
  Description of Artificial Sequence: Synthetic peptide
DRAYGDYVGWNGFDY

SEQ ID NO: 1742 - protein, 12 aa, Artificial Sequence
  Description of Artificial Sequence: Synthetic peptide
RASQSLSRSDLA

SEQ ID NO: 1743 - protein, 7 aa, Artificial Sequence
  Description of Artificial Sequence: Synthetic peptide
GASNRAT

SEQ ID NO: 1744 - protein, 9 aa, Artificial Sequence
  Description of Artificial Sequence: Synthetic peptide
QQRSNWPPT

SEQ ID NO: 1745 - protein, 5 aa, Artificial Sequence
  Description of Artificial Sequence: Synthetic peptide
QYPMW

SEQ ID NO: 1746 - protein, 17 aa, Artificial Sequence
  Description of Artificial Sequence: Synthetic peptide
YIVPSGGRTYYADSVKG

SEQ ID NO: 1747 - protein, 15 aa, Artificial Sequence
  Description of Artificial Sequence: Synthetic peptide
DRAYGDYVGWNGFDY

SEQ ID NO: 1748 - protein, 11 aa, Artificial Sequence
  Description of Artificial Sequence: Synthetic peptide
RASQSVSSYLA

SEQ ID NO: 1749 - protein, 7 aa, Artificial Sequence
  Description of Artificial Sequence: Synthetic peptide
GASNRAT

SEQ ID NO: 1750 - protein, 9 aa, Artificial Sequence
  Description of Artificial Sequence: Synthetic peptide
QQRSNWPIT

SEQ ID NO: 1751 - protein, 5 aa, Artificial Sequence
  Description of Artificial Sequence: Synthetic peptide
QYPMW

SEQ ID NO: 1752 - protein, 17 aa, Artificial Sequence
  Description of Artificial Sequence: Synthetic peptide
YIVPSGGRTYYADSVKG

SEQ ID NO: 1753 - protein, 15 aa, Artificial Sequence
  Description of Artificial Sequence: Synthetic peptide
DRAYGDYVGWNGFDY

SEQ ID NO: 1754 - protein, 11 aa, Artificial Sequence
  Description of Artificial Sequence: Synthetic peptide
RASQSVGRFLA

SEQ ID NO: 1755 - protein, 7 aa, Artificial Sequence
  Description of Artificial Sequence: Synthetic peptide
GASSRAT

SEQ ID NO: 1756 - protein, 9 aa, Artificial Sequence
  Description of Artificial Sequence: Synthetic peptide
QQRGNWPIT

SEQ ID NO: 1757 - protein, 5 aa, Artificial Sequence
  Description of Artificial Sequence: Synthetic peptide
QYPMW

SEQ ID NO: 1758 - protein, 17 aa, Artificial Sequence
  Description of Artificial Sequence: Synthetic peptide
YIVPSGGRTYYADSVKG

SEQ ID NO: 1759 - protein, 15 aa, Artificial Sequence
  Description of Artificial Sequence: Synthetic peptide
DRAYGDYVGWNGFDY

SEQ ID NO: 1760 - protein, 11 aa, Artificial Sequence
  Description of Artificial Sequence: Synthetic peptide
RASQPVGSYLA

SEQ ID NO: 1761 - protein, 7 aa, Artificial Sequence
  Description of Artificial Sequence: Synthetic peptide
GASNRAT

SEQ ID NO: 1762 - protein, 9 aa, Artificial Sequence
  Description of Artificial Sequence: Synthetic peptide
QQRGNWPLT

SEQ ID NO: 1763 - protein, 5 aa, Artificial Sequence
  Description of Artificial Sequence: Synthetic peptide
QYPMW

SEQ ID NO: 1764 - protein, 17 aa, Artificial Sequence
  Description of Artificial Sequence: Synthetic peptide
YIVPSGGRTYYADSVKG

SEQ ID NO: 1765 - protein, 15 aa, Artificial Sequence
  Description of Artificial Sequence: Synthetic peptide
DRAYGDYVGWNGFDY

SEQ ID NO: 1766 - protein, 11 aa, Artificial Sequence
  Description of Artificial Sequence: Synthetic peptide
RASQSVGYYLA

SEQ ID NO: 1767 - protein, 7 aa, Artificial Sequence
  Description of Artificial Sequence: Synthetic peptide
GASRRAT

SEQ ID NO: 1768 - protein, 9 aa, Artificial Sequence
  Description of Artificial Sequence: Synthetic peptide
QQRSNWPIT

SEQ ID NO: 1769 - protein, 5 aa, Artificial Sequence
  Description of Artificial Sequence: Synthetic peptide
QYPMW

SEQ ID NO: 1770 - protein, 17 aa, Artificial Sequence
  Description of Artificial Sequence: Synthetic peptide
YIVPSGGRTYYADSVKG

SEQ ID NO: 1771 - protein, 15 aa, Artificial Sequence
  Description of Artificial Sequence: Synthetic peptide
DRAYGDYVGWNGFDY

SEQ ID NO: 1772 - protein, 11 aa, Artificial Sequence
  Description of Artificial Sequence: Synthetic peptide
RTSQRVDSNLA

SEQ ID NO: 1773 - protein, 7 aa, Artificial Sequence
  Description of Artificial Sequence: Synthetic peptide
GASTRAT

SEQ ID NO: 1774 - protein, 9 aa, Artificial Sequence
  Description of Artificial Sequence: Synthetic peptide
QQRRKWPVT

SEQ ID NO: 1775 - protein, 5 aa, Artificial Sequence
  Description of Artificial Sequence: Synthetic peptide
QYPMW

SEQ ID NO: 1776 - protein, 17 aa, Artificial Sequence
  Description of Artificial Sequence: Synthetic peptide
YIVPSGGRTYYADSVKG

SEQ ID NO: 1777 - protein, 15 aa, Artificial Sequence
  Description of Artificial Sequence: Synthetic peptide
DRAYGDYVGWNGFDY

SEQ ID NO: 1778 - protein, 11 aa, Artificial Sequence
  Description of Artificial Sequence: Synthetic peptide
RASQSVGSDLA

SEQ ID NO: 1779 - protein, 7 aa, Artificial Sequence
  Description of Artificial Sequence: Synthetic peptide
GASSRAT

SEQ ID NO: 1780 - protein, 9 aa, Artificial Sequence
  Description of Artificial Sequence: Synthetic peptide
QQRGNWPIT

SEQ ID NO: 1781 - protein, 5 aa, Artificial Sequence
  Description of Artificial Sequence: Synthetic peptide
QYPMW

SEQ ID NO: 1782 - protein, 17 aa, Artificial Sequence
  Description of Artificial Sequence: Synthetic peptide
YIVPSGGRTYYADSVKG

SEQ ID NO: 1783 - protein, 15 aa, Artificial Sequence
  Description of Artificial Sequence: Synthetic peptide
DRAYGDYVGWNGFDY

SEQ ID NO: 1784 - protein, 11 aa, Artificial Sequence
  Description of Artificial Sequence: Synthetic peptide
RASQNIGSNLA

SEQ ID NO: 1785 - protein, 7 aa, Artificial Sequence
  Description of Artificial Sequence: Synthetic peptide
GASTRAP

SEQ ID NO: 1786 - protein, 9 aa, Artificial Sequence
  Description of Artificial Sequence: Synthetic peptide
QQRRKWPVT

SEQ ID NO: 1787 - protein, 5 aa, Artificial Sequence
  Description of Artificial Sequence: Synthetic peptide
QYPMW

SEQ ID NO: 1788 - protein, 17 aa, Artificial Sequence
  Description of Artificial Sequence: Synthetic peptide
YIVPSGGRTYYADSVKG

SEQ ID NO: 1789 - protein, 15 aa, Artificial Sequence
  Description of Artificial Sequence: Synthetic peptide
DRAYGDYVGWNGFDY

SEQ ID NO: 1790 - protein, 11 aa, Artificial Sequence
  Description of Artificial Sequence: Synthetic peptide
RASQNIITNLA

SEQ ID NO: 1791 - protein, 7 aa, Artificial Sequence
  Description of Artificial Sequence: Synthetic peptide
GASTRAT

SEQ ID NO: 1792 - protein, 9 aa, Artificial Sequence
  Description of Artificial Sequence: Synthetic peptide
QQRSNWPIT

SEQ ID NO: 1793 - protein, 5 aa, Artificial Sequence
  Description of Artificial Sequence: Synthetic peptide
QYPMW

SEQ ID NO: 1794 - protein, 17 aa, Artificial Sequence
  Description of Artificial Sequence: Synthetic peptide
YIVPSGGRTYYADSVKG

SEQ ID NO: 1795 - protein, 15 aa, Artificial Sequence
  Description of Artificial Sequence: Synthetic peptide
DRAYGDYVGWNGFDY

SEQ ID NO: 1796 - protein, 11 aa, Artificial Sequence
  Description of Artificial Sequence: Synthetic peptide
RASHSVGSDLA

SEQ ID NO: 1797 - protein, 7 aa, Artificial Sequence
  Description of Artificial Sequence: Synthetic peptide
GASTRTA

SEQ ID NO: 1798 - protein, 9 aa, Artificial Sequence
  Description of Artificial Sequence: Synthetic peptide
QQRGNWPPT

SEQ ID NO: 1799 - protein, 5 aa, Artificial Sequence
  Description of Artificial Sequence: Synthetic peptide
QYPMW

SEQ ID NO: 1800 - protein, 17 aa, Artificial Sequence
  Description of Artificial Sequence: Synthetic peptide
YIVPSGGRTYYADSVKG

SEQ ID NO: 1801 - protein, 15 aa, Artificial Sequence
  Description of Artificial Sequence: Synthetic peptide
DRAYGDYVGWNGFDY

SEQ ID NO: 1802 - protein, 11 aa, Artificial Sequence
  Description of Artificial Sequence: Synthetic peptide
RASQGVGSDLA

SEQ ID NO: 1803 - protein, 7 aa, Artificial Sequence
  Description of Artificial Sequence: Synthetic peptide
GASSRAT

SEQ ID NO: 1804 - protein, 9 aa, Artificial Sequence
  Description of Artificial Sequence: Synthetic peptide
QQRRSWPPT

SEQ ID NO: 1805 - protein, 5 aa, Artificial Sequence
  Description of Artificial Sequence: Synthetic peptide
QYPMW

SEQ ID NO: 1806 - protein, 17 aa, Artificial Sequence
  Description of Artificial Sequence: Synthetic peptide
YIVPSGGRTYYADSVKG

SEQ ID NO: 1807 - protein, 15 aa, Artificial Sequence
  Description of Artificial Sequence: Synthetic peptide
DRAYGDYVGWNGFDY

SEQ ID NO: 1808 - protein, 11 aa, Artificial Sequence
  Description of Artificial Sequence: Synthetic peptide
RASQNVNRDLA

SEQ ID NO: 1809 - protein, 7 aa, Artificial Sequence
  Description of Artificial Sequence: Synthetic peptide
GASTRAT

SEQ ID NO: 1810 - protein, 9 aa, Artificial Sequence
  Description of Artificial Sequence: Synthetic peptide
QQRGNWPIT

SEQ ID NO: 1811 - protein, 5 aa, Artificial Sequence
  Description of Artificial Sequence: Synthetic peptide
QYPMW

SEQ ID NO: 1812 - protein, 17 aa, Artificial Sequence
  Description of Artificial Sequence: Synthetic peptide
YIVPSGGRTYYADSVKG

SEQ ID NO: 1813 - protein, 15 aa, Artificial Sequence
  Description of Artificial Sequence: Synthetic peptide
DRAYGDYVGWNGFDY

SEQ ID NO: 1814 - protein, 11 aa, Artificial Sequence
  Description of Artificial Sequence: Synthetic peptide
RASQSINSDLA

SEQ ID NO: 1815 - protein, 7 aa, Artificial Sequence
  Description of Artificial Sequence: Synthetic peptide
HTSYRAP

SEQ ID NO: 1816 - protein, 9 aa, Artificial Sequence
  Description of Artificial Sequence: Synthetic peptide
QQRSDWPVT

SEQ ID NO: 1817 - protein, 5 aa, Artificial Sequence
  Description of Artificial Sequence: Synthetic peptide
QYPMW

SEQ ID NO: 1818 - protein, 17 aa, Artificial Sequence
  Description of Artificial Sequence: Synthetic peptide
YIVPSGGRTYYADSVKG

SEQ ID NO: 1819 - protein, 15 aa, Artificial Sequence
  Description of Artificial Sequence: Synthetic peptide
DRAYGDYVGWNGFDY

SEQ ID NO: 1820 - protein, 11 aa, Artificial Sequence
  Description of Artificial Sequence: Synthetic peptide
RASQSISSDLA

SEQ ID NO: 1821 - protein, 7 aa, Artificial Sequence
  Description of Artificial Sequence: Synthetic peptide
GASSRAT

SEQ ID NO: 1822 - protein, 9 aa, Artificial Sequence
  Description of Artificial Sequence: Synthetic peptide
QQRSYWPVT

SEQ ID NO: 1823 - protein, 5 aa, Artificial Sequence
  Description of Artificial Sequence: Synthetic peptide
QYPMW

SEQ ID NO: 1824 - protein, 17 aa, Artificial Sequence
  Description of Artificial Sequence: Synthetic peptide
YIVPSGGRTYYADSVKG

SEQ ID NO: 1825 - protein, 15 aa, Artificial Sequence
  Description of Artificial Sequence: Synthetic peptide
DRAYGDYVGWNGFDY

SEQ ID NO: 1826 - protein, 11 aa, Artificial Sequence
  Description of Artificial Sequence: Synthetic peptide
RASQSISSFLA

SEQ ID NO: 1827 - protein, 7 aa, Artificial Sequence
  Description of Artificial Sequence: Synthetic peptide
DASYRAT

SEQ ID NO: 1828 - protein, 9 aa, Artificial Sequence
  Description of Artificial Sequence: Synthetic peptide
QQRGNWPIT

SEQ ID NO: 1829 - protein, 5 aa, Artificial Sequence
  Description of Artificial Sequence: Synthetic peptide
QYPMW

SEQ ID NO: 1830 - protein, 17 aa, Artificial Sequence
  Description of Artificial Sequence: Synthetic peptide
YIVPSGGRTYYADSVKG

SEQ ID NO: 1831 - protein, 15 aa, Artificial Sequence
  Description of Artificial Sequence: Synthetic peptide
DRAYGDYVGWNGFDY

SEQ ID NO: 1832 - protein, 11 aa, Artificial Sequence
  Description of Artificial Sequence: Synthetic peptide
RASQSVGADLA

SEQ ID NO: 1833 - protein, 7 aa, Artificial Sequence
  Description of Artificial Sequence: Synthetic peptide
HASTRAT

SEQ ID NO: 1834 - protein, 9 aa, Artificial Sequence
  Description of Artificial Sequence: Synthetic peptide
QQRGNWPPT

SEQ ID NO: 1835 - protein, 5 aa, Artificial Sequence
  Description of Artificial Sequence: Synthetic peptide
QYPMW

SEQ ID NO: 1836 - protein, 17 aa, Artificial Sequence
  Description of Artificial Sequence: Synthetic peptide
YIVPSGGRTYYADSVKG

SEQ ID NO: 1837 - protein, 15 aa, Artificial Sequence
  Description of Artificial Sequence: Synthetic peptide
DRAYGDYVGWNGFDY

SEQ ID NO: 1838 - protein, 11 aa, Artificial Sequence
  Description of Artificial Sequence: Synthetic peptide
RASQSVGSDLA

SEQ ID NO: 1839 - protein, 7 aa, Artificial Sequence
  Description of Artificial Sequence: Synthetic peptide
GASHRAT

SEQ ID NO: 1840 - protein, 9 aa, Artificial Sequence
  Description of Artificial Sequence: Synthetic peptide
QQRYNWPIT

SEQ ID NO: 1841 - protein, 5 aa, Artificial Sequence
  Description of Artificial Sequence: Synthetic peptide
QYPMW

SEQ ID NO: 1842 - protein, 17 aa, Artificial Sequence
  Description of Artificial Sequence: Synthetic peptide
YIVPSGGRTYYADSVKG

SEQ ID NO: 1843 - protein, 15 aa, Artificial Sequence
  Description of Artificial Sequence: Synthetic peptide
DRAYGDYVGWNGFDY

SEQ ID NO: 1844 - protein, 11 aa, Artificial Sequence
  Description of Artificial Sequence: Synthetic peptide
RASQSVGSDLA

SEQ ID NO: 1845 - protein, 7 aa, Artificial Sequence
  Description of Artificial Sequence: Synthetic peptide
GASTRAT

SEQ ID NO: 1846 - protein, 9 aa, Artificial Sequence
  Description of Artificial Sequence: Synthetic peptide
QQRGNWPPT

SEQ ID NO: 1847 - protein, 5 aa, Artificial Sequence
  Description of Artificial Sequence: Synthetic peptide
QYPMW

SEQ ID NO: 1848 - protein, 17 aa, Artificial Sequence
  Description of Artificial Sequence: Synthetic peptide
YIVPSGGRTYYADSVKG

SEQ ID NO: 1849 - protein, 15 aa, Artificial Sequence
  Description of Artificial Sequence: Synthetic peptide
DRAYGDYVGWNGFDY

SEQ ID NO: 1850 - protein, 11 aa, Artificial Sequence
  Description of Artificial Sequence: Synthetic peptide
RASQSVGSNLA

SEQ ID NO: 1851 - protein, 7 aa, Artificial Sequence
  Description of Artificial Sequence: Synthetic peptide
GASIRAT

SEQ ID NO: 1852 - protein, 9 aa, Artificial Sequence
  Description of Artificial Sequence: Synthetic peptide
QQRGNWPIT

SEQ ID NO: 1853 - protein, 5 aa, Artificial Sequence
  Description of Artificial Sequence: Synthetic peptide
QYPMW

SEQ ID NO: 1854 - protein, 17 aa, Artificial Sequence
  Description of Artificial Sequence: Synthetic peptide
YIVPSGGRTYYADSVKG

SEQ ID NO: 1855 - protein, 15 aa, Artificial Sequence
  Description of Artificial Sequence: Synthetic peptide
DRAYGDYVGWNGFDY

SEQ ID NO: 1856 - protein, 11 aa, Artificial Sequence
  Description of Artificial Sequence: Synthetic peptide
RASQSVGSNLA

SEQ ID NO: 1857 - protein, 7 aa, Artificial Sequence
  Description of Artificial Sequence: Synthetic peptide
GASTRAT

SEQ ID NO: 1858 - protein, 9 aa, Artificial Sequence
  Description of Artificial Sequence: Synthetic peptide
QQRAYWPVS

SEQ ID NO: 1859 - protein, 5 aa, Artificial Sequence
  Description of Artificial Sequence: Synthetic peptide
QYPMW

SEQ ID NO: 1860 - protein, 17 aa, Artificial Sequence
  Description of Artificial Sequence: Synthetic peptide
YIVPSGGRTYYADSVKG

SEQ ID NO: 1861 - protein, 15 aa, Artificial Sequence
  Description of Artificial Sequence: Synthetic peptide
DRAYGDYVGWNGFDY

SEQ ID NO: 1862 - protein, 11 aa, Artificial Sequence
  Description of Artificial Sequence: Synthetic peptide
RASQSVGSNLA

SEQ ID NO: 1863 - protein, 7 aa, Artificial Sequence
  Description of Artificial Sequence: Synthetic peptide
GASTRAT

SEQ ID NO: 1864 - protein, 9 aa, Artificial Sequence
  Description of Artificial Sequence: Synthetic peptide
QQRGNWPIT

SEQ ID NO: 1865 - protein, 5 aa, Artificial Sequence
  Description of Artificial Sequence: Synthetic peptide
QYPMW

SEQ ID NO: 1866 - protein, 17 aa, Artificial Sequence
  Description of Artificial Sequence: Synthetic peptide
YIVPSGGRTYYADSVKG

SEQ ID NO: 1867 - protein, 15 aa, Artificial Sequence
  Description of Artificial Sequence: Synthetic peptide
DRAYGDYVGWNGFDY

SEQ ID NO: 1868 - protein, 11 aa, Artificial Sequence
  Description of Artificial Sequence: Synthetic peptide
RASQSVGSNLA

SEQ ID NO: 1869 - protein, 7 aa, Artificial Sequence
  Description of Artificial Sequence: Synthetic peptide
GASTRAT

SEQ ID NO: 1870 - protein, 9 aa, Artificial Sequence
  Description of Artificial Sequence: Synthetic peptide
QQRRNWPVT

SEQ ID NO: 1871 - protein, 5 aa, Artificial Sequence
  Description of Artificial Sequence: Synthetic peptide
QYPMW

SEQ ID NO: 1872 - protein, 17 aa, Artificial Sequence
  Description of Artificial Sequence: Synthetic peptide
YIVPSGGRTYYADSVKG

SEQ ID NO: 1873 - protein, 15 aa, Artificial Sequence
  Description of Artificial Sequence: Synthetic peptide
DRAYGDYVGWNGFDY

SEQ ID NO: 1874 - protein, 11 aa, Artificial Sequence
  Description of Artificial Sequence: Synthetic peptide
RASQSVGSQLA

SEQ ID NO: 1875 - protein, 7 aa, Artificial Sequence
  Description of Artificial Sequence: Synthetic peptide
DASTRAT

SEQ ID NO: 1876 - protein, 9 aa, Artificial Sequence
  Description of Artificial Sequence: Synthetic peptide
QQRGNWPIT

SEQ ID NO: 1877 - protein, 5 aa, Artificial Sequence
  Description of Artificial Sequence: Synthetic peptide
QYPMW

SEQ ID NO: 1878 - protein, 17 aa, Artificial Sequence
  Description of Artificial Sequence: Synthetic peptide
YIVPSGGRTYYADSVKG

SEQ ID NO: 1879 - protein, 15 aa, Artificial Sequence
  Description of Artificial Sequence: Synthetic peptide
DRAYGDYVGWNGFDY

SEQ ID NO: 1880 - protein, 11 aa, Artificial Sequence
  Description of Artificial Sequence: Synthetic peptide
RASQSVNSDLA

SEQ ID NO: 1881 - protein, 7 aa, Artificial Sequence
  Description of Artificial Sequence: Synthetic peptide
GASTRAT

SEQ ID NO: 1882 - protein, 9 aa, Artificial Sequence
  Description of Artificial Sequence: Synthetic peptide
QQRGNWPIT

SEQ ID NO: 1883 - protein, 5 aa, Artificial Sequence
  Description of Artificial Sequence: Synthetic peptide
QYPMW

SEQ ID NO: 1884 - protein, 17 aa, Artificial Sequence
  Description of Artificial Sequence: Synthetic peptide
YIVPSGGRTYYADSVKG

SEQ ID NO: 1885 - protein, 15 aa, Artificial Sequence
  Description of Artificial Sequence: Synthetic peptide
DRAYGDYVGWNGFDY

SEQ ID NO: 1886 - protein, 11 aa, Artificial Sequence
  Description of Artificial Sequence: Synthetic peptide
RASQSVNTDLA

SEQ ID NO: 1887 - protein, 7 aa, Artificial Sequence
  Description of Artificial Sequence: Synthetic peptide
GASTRAT

SEQ ID NO: 1888 - protein, 9 aa, Artificial Sequence
  Description of Artificial Sequence: Synthetic peptide
QQRRNWPVT

SEQ ID NO: 1889 - protein, 5 aa, Artificial Sequence
  Description of Artificial Sequence: Synthetic peptide
QYPMW

SEQ ID NO: 1890 - protein, 17 aa, Artificial Sequence
  Description of Artificial Sequence: Synthetic peptide
YIVPSGGRTYYADSVKG

SEQ ID NO: 1891 - protein, 15 aa, Artificial Sequence
  Description of Artificial Sequence: Synthetic peptide
DRAYGDYVGWNGFDY

SEQ ID NO: 1892 - protein, 11 aa, Artificial Sequence
  Description of Artificial Sequence: Synthetic peptide
RASQSVSSDLA

SEQ ID NO: 1893 - protein, 7 aa, Artificial Sequence
  Description of Artificial Sequence: Synthetic peptide
GASTRAT

SEQ ID NO: 1894 - protein, 9 aa, Artificial Sequence
  Description of Artificial Sequence: Synthetic peptide
QQRRKWPVT

SEQ ID NO: 1895 - protein, 5 aa, Artificial Sequence
  Description of Artificial Sequence: Synthetic peptide
QYPMW

SEQ ID NO: 1896 - protein, 17 aa, Artificial Sequence
  Description of Artificial Sequence: Synthetic peptide
YIVPSGGRTYYADSVKG

SEQ ID NO: 1897 - protein, 15 aa, Artificial Sequence
  Description of Artificial Sequence: Synthetic peptide
DRAYGDYVGWNGFDY

SEQ ID NO: 1898 - protein, 11 aa, Artificial Sequence
  Description of Artificial Sequence: Synthetic peptide
RASQSVSSDLA

SEQ ID NO: 1899 - protein, 7 aa, Artificial Sequence
  Description of Artificial Sequence: Synthetic peptide
AASTRAT

SEQ ID NO: 1900 - protein, 9 aa, Artificial Sequence
  Description of Artificial Sequence: Synthetic peptide
QQRSNWPVT

SEQ ID NO: 1901 - protein, 5 aa, Artificial Sequence
  Description of Artificial Sequence: Synthetic peptide
QYPMW

SEQ ID NO: 1902 - protein, 17 aa, Artificial Sequence
  Description of Artificial Sequence: Synthetic peptide
YIVPSGGRTYYADSVKG

SEQ ID NO: 1903 - protein, 15 aa, Artificial Sequence
  Description of Artificial Sequence: Synthetic peptide
DRAYGDYVGWNGFDY

SEQ ID NO: 1904 - protein, 11 aa, Artificial Sequence
  Description of Artificial Sequence: Synthetic peptide
RASQSVSSDLA

SEQ ID NO: 1905 - protein, 7 aa, Artificial Sequence
  Description of Artificial Sequence: Synthetic peptide
HTSYRAP

SEQ ID NO: 1906 - protein, 9 aa, Artificial Sequence
  Description of Artificial Sequence: Synthetic peptide
QQRSDWPVT

SEQ ID NO: 1907 - protein, 5 aa, Artificial Sequence
  Description of Artificial Sequence: Synthetic peptide
QYPMW

SEQ ID NO: 1908 - protein, 17 aa, Artificial Sequence
  Description of Artificial Sequence: Synthetic peptide
YIVPSGGRTYYADSVKG

SEQ ID NO: 1909 - protein, 15 aa, Artificial Sequence
  Description of Artificial Sequence: Synthetic peptide
DRAYGDYVGWNGFDY

SEQ ID NO: 1910 - protein, 11 aa, Artificial Sequence
  Description of Artificial Sequence: Synthetic peptide
RASQSVSSDLA

SEQ ID NO: 1911 - protein, 7 aa, Artificial Sequence
  Description of Artificial Sequence: Synthetic peptide
RASIRAT

SEQ ID NO: 1912 - protein, 9 aa, Artificial Sequence
  Description of Artificial Sequence: Synthetic peptide
QQRGFWPIT

SEQ ID NO: 1913 - protein, 5 aa, Artificial Sequence
  Description of Artificial Sequence: Synthetic peptide
QYPMW

SEQ ID NO: 1914 - protein, 17 aa, Artificial Sequence
  Description of Artificial Sequence: Synthetic peptide
YIVPSGGRTYYADSVKG

SEQ ID NO: 1915 - protein, 15 aa, Artificial Sequence
  Description of Artificial Sequence: Synthetic peptide
DRAYGDYVGWNGFDY

SEQ ID NO: 1916 - protein, 11 aa, Artificial Sequence
  Description of Artificial Sequence: Synthetic peptide
RASQSVSSDLA

SEQ ID NO: 1917 - protein, 7 aa, Artificial Sequence
  Description of Artificial Sequence: Synthetic peptide
RASIRAT

SEQ ID NO: 1918 - protein, 9 aa, Artificial Sequence
  Description of Artificial Sequence: Synthetic peptide
QQRSAWPVT

SEQ ID NO: 1919 - protein, 5 aa, Artificial Sequence
  Description of Artificial Sequence: Synthetic peptide
QYPMW

SEQ ID NO: 1920 - protein, 17 aa, Artificial Sequence
  Description of Artificial Sequence: Synthetic peptide
YIVPSGGRTYYADSVKG

SEQ ID NO: 1921 - protein, 15 aa, Artificial Sequence
  Description of Artificial Sequence: Synthetic peptide
DRAYGDYVGWNGFDY

SEQ ID NO: 1922 - protein, 11 aa, Artificial Sequence
  Description of Artificial Sequence: Synthetic peptide
RASQSVSSDLA

SEQ ID NO: 1923 - protein, 7 aa, Artificial Sequence
  Description of Artificial Sequence: Synthetic peptide
GASTRAT

SEQ ID NO: 1924 - protein, 9 aa, Artificial Sequence
  Description of Artificial Sequence: Synthetic peptide
QQRSNWPPT

SEQ ID NO: 1925 - protein, 5 aa, Artificial Sequence
  Description of Artificial Sequence: Synthetic peptide
QYPMW

SEQ ID NO: 1926 - protein, 17 aa, Artificial Sequence
  Description of Artificial Sequence: Synthetic peptide
YIVPSGGRTYYADSVKG

SEQ ID NO: 1927 - protein, 15 aa, Artificial Sequence
  Description of Artificial Sequence: Synthetic peptide
DRAYGDYVGWNGFDY

SEQ ID NO: 1928 - protein, 11 aa, Artificial Sequence
  Description of Artificial Sequence: Synthetic peptide
RASQSVSSNLA

SEQ ID NO: 1929 - protein, 7 aa, Artificial Sequence
  Description of Artificial Sequence: Synthetic peptide
GASTRAT

SEQ ID NO: 1930 - protein, 9 aa, Artificial Sequence
  Description of Artificial Sequence: Synthetic peptide
QQCYNWPPT

SEQ ID NO: 1931 - protein, 5 aa, Artificial Sequence
  Description of Artificial Sequence: Synthetic peptide
QYPMW

SEQ ID NO: 1932 - protein, 17 aa, Artificial Sequence
  Description of Artificial Sequence: Synthetic peptide
YIVPSGGRTYYADSVKG

SEQ ID NO: 1933 - protein, 15 aa, Artificial Sequence
  Description of Artificial Sequence: Synthetic peptide
DRAYGDYVGWNGFDY

SEQ ID NO: 1934 - protein, 11 aa, Artificial Sequence
  Description of Artificial Sequence: Synthetic peptide
RASQSVSSNLA

SEQ ID NO: 1935 - protein, 7 aa, Artificial Sequence
  Description of Artificial Sequence: Synthetic peptide
GASTRAT

SEQ ID NO: 1936 - protein, 9 aa, Artificial Sequence
  Description of Artificial Sequence: Synthetic peptide
QQRGNWPIT

SEQ ID NO: 1937 - protein, 5 aa, Artificial Sequence
  Description of Artificial Sequence: Synthetic peptide
QYPMW

SEQ ID NO: 1938 - protein, 17 aa, Artificial Sequence
  Description of Artificial Sequence: Synthetic peptide
YIVPSGGRTYYADSVKG

SEQ ID NO: 1939 - protein, 15 aa, Artificial Sequence
  Description of Artificial Sequence: Synthetic peptide
DRAYGDYVGWNGFDY

SEQ ID NO: 1940 - protein, 11 aa, Artificial Sequence
  Description of Artificial Sequence: Synthetic peptide
RASQSVSSNLA

SEQ ID NO: 1941 - protein, 7 aa, Artificial Sequence
  Description of Artificial Sequence: Synthetic peptide
GASTRAT

SEQ ID NO: 1942 - protein, 9 aa, Artificial Sequence
  Description of Artificial Sequence: Synthetic peptide
QQRRNWPVT

SEQ ID NO: 1943 - protein, 5 aa, Artificial Sequence
  Description of Artificial Sequence: Synthetic peptide
QYPMW

SEQ ID NO: 1944 - protein, 17 aa, Artificial Sequence
  Description of Artificial Sequence: Synthetic peptide
YIVPSGGRTYYADSVKG

SEQ ID NO: 1945 - protein, 15 aa, Artificial Sequence
  Description of Artificial Sequence: Synthetic peptide
DRAYGDYVGWNGFDY

SEQ ID NO: 1946 - protein, 11 aa, Artificial Sequence
  Description of Artificial Sequence: Synthetic peptide
RASQSVSSNLA

SEQ ID NO: 1947 - protein, 7 aa, Artificial Sequence
  Description of Artificial Sequence: Synthetic peptide
HASTRAT

SEQ ID NO: 1948 - protein, 9 aa, Artificial Sequence
  Description of Artificial Sequence: Synthetic peptide
QQRGFWPIT

SEQ ID NO: 1949 - protein, 5 aa, Artificial Sequence
  Description of Artificial Sequence: Synthetic peptide
QYPMW

SEQ ID NO: 1950 - protein, 17 aa, Artificial Sequence
  Description of Artificial Sequence: Synthetic peptide
YIVPSGGRTYYADSVKG

SEQ ID NO: 1951 - protein, 15 aa, Artificial Sequence
  Description of Artificial Sequence: Synthetic peptide
DRAYGDYVGWNGFDY

SEQ ID NO: 1952 - protein, 11 aa, Artificial Sequence
  Description of Artificial Sequence: Synthetic peptide
RASQSVSSYLA

SEQ ID NO: 1953 - protein, 7 aa, Artificial Sequence
  Description of Artificial Sequence: Synthetic peptide
GASNTAT

SEQ ID NO: 1954 - protein, 9 aa, Artificial Sequence
  Description of Artificial Sequence: Synthetic peptide
QQRRNWPPT

SEQ ID NO: 1955 - protein, 5 aa, Artificial Sequence
  Description of Artificial Sequence: Synthetic peptide
QYPMW

SEQ ID NO: 1956 - protein, 17 aa, Artificial Sequence
  Description of Artificial Sequence: Synthetic peptide
YIVPSGGRTYYADSVKG

SEQ ID NO: 1957 - protein, 15 aa, Artificial Sequence
  Description of Artificial Sequence: Synthetic peptide
DRAYGDYVGWNGFDY

SEQ ID NO: 1958 - protein, 11 aa, Artificial Sequence
  Description of Artificial Sequence: Synthetic peptide
RASQSVWSNLA

SEQ ID NO: 1959 - protein, 7 aa, Artificial Sequence
  Description of Artificial Sequence: Synthetic peptide
DASYRAT

SEQ ID NO: 1960 - protein, 9 aa, Artificial Sequence
  Description of Artificial Sequence: Synthetic peptide
QQRGNWPIT

SEQ ID NO: 1961 - protein, 5 aa, Artificial Sequence
  Description of Artificial Sequence: Synthetic peptide
QYPMW

SEQ ID NO: 1962 - protein, 17 aa, Artificial Sequence
  Description of Artificial Sequence: Synthetic peptide
YIVPSGGRTYYADSVKG

SEQ ID NO: 1963 - protein, 15 aa, Artificial Sequence
  Description of Artificial Sequence: Synthetic peptide
DRAYGDYVGWNGFDY

SEQ ID NO: 1964 - protein, 11 aa, Artificial Sequence
  Description of Artificial Sequence: Synthetic peptide
RASQTVGTFLA

SEQ ID NO: 1965 - protein, 7 aa, Artificial Sequence
  Description of Artificial Sequence: Synthetic peptide
GASTRAT

SEQ ID NO: 1966 - protein, 9 aa, Artificial Sequence
  Description of Artificial Sequence: Synthetic peptide
QQRSNWPPT

SEQ ID NO: 1967 - protein, 5 aa, Artificial Sequence
  Description of Artificial Sequence: Synthetic peptide
QYPMW

SEQ ID NO: 1968 - protein, 17 aa, Artificial Sequence
  Description of Artificial Sequence: Synthetic peptide
YIVPSGGRTYYADSVKG

SEQ ID NO: 1969 - protein, 15 aa, Artificial Sequence
  Description of Artificial Sequence: Synthetic peptide
DRAYGDYVGWNGFDY

SEQ ID NO: 1970 - protein, 11 aa, Artificial Sequence
  Description of Artificial Sequence: Synthetic peptide
RASESVNSDLA

SEQ ID NO: 1971 - protein, 7 aa, Artificial Sequence
  Description of Artificial Sequence: Synthetic peptide
GASTRAT

SEQ ID NO: 1972 - protein, 9 aa, Artificial Sequence
  Description of Artificial Sequence: Synthetic peptide
QQRGSWPIT

SEQ ID NO: 1973 - protein, 5 aa, Artificial Sequence
  Description of Artificial Sequence: Synthetic peptide
QYPMW

SEQ ID NO: 1974 - protein, 17 aa, Artificial Sequence
  Description of Artificial Sequence: Synthetic peptide
YIVPSGGRTYYADSVKG

SEQ ID NO: 1975 - protein, 15 aa, Artificial Sequence
  Description of Artificial Sequence: Synthetic peptide
DRAYGDYVGWNGFDY

SEQ ID NO: 1976 - protein, 11 aa, Artificial Sequence
  Description of Artificial Sequence: Synthetic peptide
RASQNINSDLA

SEQ ID NO: 1977 - protein, 7 aa, Artificial Sequence
  Description of Artificial Sequence: Synthetic peptide
GASTRAT

SEQ ID NO: 1978 - protein, 9 aa, Artificial Sequence
  Description of Artificial Sequence: Synthetic peptide
QQRGGWPIT

SEQ ID NO: 1979 - protein, 5 aa, Artificial Sequence
  Description of Artificial Sequence: Synthetic peptide
QYPMW

SEQ ID NO: 1980 - protein, 17 aa, Artificial Sequence
  Description of Artificial Sequence: Synthetic peptide
YIVPSGGRTYYADSVKG

SEQ ID NO: 1981 - protein, 15 aa, Artificial Sequence
  Description of Artificial Sequence: Synthetic peptide
DRAYGDYVGWNGFDY

SEQ ID NO: 1982 - protein, 11 aa, Artificial Sequence
  Description of Artificial Sequence: Synthetic peptide
KASHSISRNLA

SEQ ID NO: 1983 - protein, 7 aa, Artificial Sequence
  Description of Artificial Sequence: Synthetic peptide
GASTRAT

SEQ ID NO: 1984 - protein, 9 aa, Artificial Sequence
  Description of Artificial Sequence: Synthetic peptide
QQRRNWPVT

SEQ ID NO: 1985 - protein, 5 aa, Artificial Sequence
  Description of Artificial Sequence: Synthetic peptide
QYPMW

SEQ ID NO: 1986 - protein, 17 aa, Artificial Sequence
  Description of Artificial Sequence: Synthetic peptide
YIVPSGGRTYYADSVKG

SEQ ID NO: 1987 - protein, 15 aa, Artificial Sequence
  Description of Artificial Sequence: Synthetic peptide
DRAYGDYVGWNGFDY

SEQ ID NO: 1988 - protein, 11 aa, Artificial Sequence
  Description of Artificial Sequence: Synthetic peptide
RASQTIFGDLA

SEQ ID NO: 1989 - protein, 7 aa, Artificial Sequence
  Description of Artificial Sequence: Synthetic peptide
GASTRAT

SEQ ID NO: 1990 - protein, 9 aa, Artificial Sequence
  Description of Artificial Sequence: Synthetic peptide
QQRSNWPPT

SEQ ID NO: 1991 - protein, 5 aa, Artificial Sequence
  Description of Artificial Sequence: Synthetic peptide
QYPMW

SEQ ID NO: 1992 - protein, 17 aa, Artificial Sequence
  Description of Artificial Sequence: Synthetic peptide
YIVPSGGRTYYADSVKG

SEQ ID NO: 1993 - protein, 15 aa, Artificial Sequence
  Description of Artificial Sequence: Synthetic peptide
DRAYGDYVGWNGFDY

SEQ ID NO: 1994 - protein, 11 aa, Artificial Sequence
  Description of Artificial Sequence: Synthetic peptide
RASRSVSNNVA

SEQ ID NO: 1995 - protein, 7 aa, Artificial Sequence
  Description of Artificial Sequence: Synthetic peptide
EASNRAT

SEQ ID NO: 1996 - protein, 9 aa, Artificial Sequence
  Description of Artificial Sequence: Synthetic peptide
QQRGGWPIT

SEQ ID NO: 1997 - protein, 5 aa, Artificial Sequence
  Description of Artificial Sequence: Synthetic peptide
QYPMW

SEQ ID NO: 1998 - protein, 17 aa, Artificial Sequence
  Description of Artificial Sequence: Synthetic peptide
YIVPSGGRTYYADSVKG

SEQ ID NO: 1999 - protein, 15 aa, Artificial Sequence
  Description of Artificial Sequence: Synthetic peptide
DRAYGDYVGWNGFDY

SEQ ID NO: 2000 - protein, 11 aa, Artificial Sequence
  Description of Artificial Sequence: Synthetic peptide
RASQSVSNYLA

SEQ ID NO: 2001 - protein, 7 aa, Artificial Sequence
  Description of Artificial Sequence: Synthetic peptide
GASNRAT

SEQ ID NO: 2002 - protein, 9 aa, Artificial Sequence
  Description of Artificial Sequence: Synthetic peptide
QQRRSWPPT

SEQ ID NO: 2003 - protein, 5 aa, Artificial Sequence
  Description of Artificial Sequence: Synthetic peptide
QYPMW

SEQ ID NO: 2004 - protein, 17 aa, Artificial Sequence
  Description of Artificial Sequence: Synthetic peptide
YIVPSGGRTYYADSVKG

SEQ ID NO: 2005 - protein, 15 aa, Artificial Sequence
  Description of Artificial Sequence: Synthetic peptide
DRAYGDYVGWNGFDY

SEQ ID NO: 2006 - protein, 11 aa, Artificial Sequence
  Description of Artificial Sequence: Synthetic peptide
RASQSVGSDLA

SEQ ID NO: 2007 - protein, 7 aa, Artificial Sequence
  Description of Artificial Sequence: Synthetic peptide
GASTRAT

SEQ ID NO: 2008 - protein, 9 aa, Artificial Sequence
  Description of Artificial Sequence: Synthetic peptide
QQRSNWPVT

SEQ ID NO: 2009 - protein, 5 aa, Artificial Sequence
  Description of Artificial Sequence: Synthetic peptide
QYPMW

SEQ ID NO: 2010 - protein, 17 aa, Artificial Sequence
  Description of Artificial Sequence: Synthetic peptide
YIVPSGGRTYYADSVKG

SEQ ID NO: 2011 - protein, 15 aa, Artificial Sequence
  Description of Artificial Sequence: Synthetic peptide
DRAYGDYVGWNGFDY

SEQ ID NO: 2012 - protein, 11 aa, Artificial Sequence
  Description of Artificial Sequence: Synthetic peptide
RASQSVNSHVA

SEQ ID NO: 2013 - protein, 7 aa, Artificial Sequence
  Description of Artificial Sequence: Synthetic peptide
EASDRAA

SEQ ID NO: 2014 - protein, 9 aa, Artificial Sequence
  Description of Artificial Sequence: Synthetic peptide
QQRMYWPPT

SEQ ID NO: 2015 - protein, 5 aa, Artificial Sequence
  Description of Artificial Sequence: Synthetic peptide
QYPMW

SEQ ID NO: 2016 - protein, 17 aa, Artificial Sequence
  Description of Artificial Sequence: Synthetic peptide
YIVPSGGRTYYADSVKG

SEQ ID NO: 2017 - protein, 15 aa, Artificial Sequence
  Description of Artificial Sequence: Synthetic peptide
DRAYGDYVGWNGFDY

SEQ ID NO: 2018 - protein, 12 aa, Artificial Sequence
  Description of Artificial Sequence: Synthetic peptide
RASQSLSRSDLA

SEQ ID NO: 2019 - protein, 7 aa, Artificial Sequence
  Description of Artificial Sequence: Synthetic peptide
GASNRAT

SEQ ID NO: 2020 - protein, 9 aa, Artificial Sequence
  Description of Artificial Sequence: Synthetic peptide
QQRSNWPPT

SEQ ID NO: 2021 - protein, 5 aa, Artificial Sequence
  Description of Artificial Sequence: Synthetic peptide
QYPMW

SEQ ID NO: 2022 - protein, 17 aa, Artificial Sequence
  Description of Artificial Sequence: Synthetic peptide
YIVPSGGRTYYADSVKG

SEQ ID NO: 2023 - protein, 15 aa, Artificial Sequence
  Description of Artificial Sequence: Synthetic peptide
DRAYGDYVGWNGFDY

SEQ ID NO: 2024 - protein, 11 aa, Artificial Sequence
  Description of Artificial Sequence: Synthetic peptide
RASQNIGSNLA

SEQ ID NO: 2025 - protein, 7 aa, Artificial Sequence
  Description of Artificial Sequence: Synthetic peptide
GATTRAT

SEQ ID NO: 2026 - protein, 9 aa, Artificial Sequence
  Description of Artificial Sequence: Synthetic peptide
QQRGNWPIT

SEQ ID NO: 2027 - protein, 5 aa, Artificial Sequence
  Description of Artificial Sequence: Synthetic peptide
QYPMW

SEQ ID NO: 2028 - protein, 17 aa, Artificial Sequence
  Description of Artificial Sequence: Synthetic peptide
YIVPSGGRTYYADSVKG

SEQ ID NO: 2029 - protein, 15 aa, Artificial Sequence
  Description of Artificial Sequence: Synthetic peptide
DRAYGDYVGWNGFDY

SEQ ID NO: 2030 - protein, 11 aa, Artificial Sequence
  Description of Artificial Sequence: Synthetic peptide
RASQGINNNLA

SEQ ID NO: 2031 - protein, 7 aa, Artificial Sequence
  Description of Artificial Sequence: Synthetic peptide
DASNRAT

SEQ ID NO: 2032 - protein, 9 aa, Artificial Sequence
  Description of Artificial Sequence: Synthetic peptide
QQRGNWPIT

SEQ ID NO: 2033 - protein, 5 aa, Artificial Sequence
  Description of Artificial Sequence: Synthetic peptide
QYPMW

SEQ ID NO: 2034 - protein, 17 aa, Artificial Sequence
  Description of Artificial Sequence: Synthetic peptide
YIVPSGGRTYYADSVKG

SEQ ID NO: 2035 - protein, 15 aa, Artificial Sequence
  Description of Artificial Sequence: Synthetic peptide
DRAYGDYVGWNGFDY

SEQ ID NO: 2036 - protein, 11 aa, Artificial Sequence
  Description of Artificial Sequence: Synthetic peptide
RASQSVSSDLA

SEQ ID NO: 2037 - protein, 7 aa, Artificial Sequence
  Description of Artificial Sequence: Synthetic peptide
GASNRAT

SEQ ID NO: 2038 - protein, 9 aa, Artificial Sequence
  Description of Artificial Sequence: Synthetic peptide
QQRSKWPIT

SEQ ID NO: 2039 - protein, 5 aa, Artificial Sequence
  Description of Artificial Sequence: Synthetic peptide
QYPMW

SEQ ID NO: 2040 - protein, 17 aa, Artificial Sequence
  Description of Artificial Sequence: Synthetic peptide
YIVPSGGRTYYADSVKG

SEQ ID NO: 2041 - protein, 15 aa, Artificial Sequence
  Description of Artificial Sequence: Synthetic peptide
DRAYGDYVGWNGFDY

SEQ ID NO: 2042 - protein, 11 aa, Artificial Sequence
  Description of Artificial Sequence: Synthetic peptide
RASQSVGSDLA

SEQ ID NO: 2043 - protein, 7 aa, Artificial Sequence
  Description of Artificial Sequence: Synthetic peptide
GASNRAT

SEQ ID NO: 2044 - protein, 9 aa, Artificial Sequence
  Description of Artificial Sequence: Synthetic peptide
QQRSNWPIT

SEQ ID NO: 2045 - protein, 5 aa, Artificial Sequence
  Description of Artificial Sequence: Synthetic peptide
QYPMW

SEQ ID NO: 2046 - protein, 17 aa, Artificial Sequence
  Description of Artificial Sequence: Synthetic peptide
YIVPSGGRTYYADSVKG

SEQ ID NO: 2047 - protein, 15 aa, Artificial Sequence
  Description of Artificial Sequence: Synthetic peptide
DRAYGDYVGWNGFDY

SEQ ID NO: 2048 - protein, 11 aa, Artificial Sequence
  Description of Artificial Sequence: Synthetic peptide
RASQSVGSFLA

SEQ ID NO: 2049 - protein, 7 aa, Artificial Sequence
  Description of Artificial Sequence: Synthetic peptide
GASNRAP

SEQ ID NO: 2050 - protein, 9 aa, Artificial Sequence
  Description of Artificial Sequence: Synthetic peptide
QQRHNWPIT

SEQ ID NO: 2051 - protein, 5 aa, Artificial Sequence
  Description of Artificial Sequence: Synthetic peptide
QYPMW

SEQ ID NO: 2052 - protein, 17 aa, Artificial Sequence
  Description of Artificial Sequence: Synthetic peptide
YIVPSGGRTYYADSVKG

SEQ ID NO: 2053 - protein, 15 aa, Artificial Sequence
  Description of Artificial Sequence: Synthetic peptide
DRAYGDYVGWNGFDY

SEQ ID NO: 2054 - protein, 11 aa, Artificial Sequence
  Description of Artificial Sequence: Synthetic peptide
RASQSVSNYLA

SEQ ID NO: 2055 - protein, 7 aa, Artificial Sequence
  Description of Artificial Sequence: Synthetic peptide
GVSNRAT

SEQ ID NO: 2056 - protein, 9 aa, Artificial Sequence
  Description of Artificial Sequence: Synthetic peptide
QQRGNWPPT

SEQ ID NO: 2057 - protein, 5 aa, Artificial Sequence
  Description of Artificial Sequence: Synthetic peptide
QYPMW

SEQ ID NO: 2058 - protein, 17 aa, Artificial Sequence
  Description of Artificial Sequence: Synthetic peptide
YIVPSGGRTYYADSVKG

SEQ ID NO: 2059 - protein, 15 aa, Artificial Sequence
  Description of Artificial Sequence: Synthetic peptide
DRAYGDYVGWNGFDY

SEQ ID NO: 2060 - protein, 12 aa, Artificial Sequence
  Description of Artificial Sequence: Synthetic peptide
RASQNLGRSDLA

SEQ ID NO: 2061 - protein, 7 aa, Artificial Sequence
  Description of Artificial Sequence: Synthetic peptide
GVSNRAT

SEQ ID NO: 2062 - protein, 9 aa, Artificial Sequence
  Description of Artificial Sequence: Synthetic peptide
QQRSNWPPT

SEQ ID NO: 2063 - protein, 5 aa, Artificial Sequence
  Description of Artificial Sequence: Synthetic peptide
QYPMW

SEQ ID NO: 2064 - protein, 17 aa, Artificial Sequence
  Description of Artificial Sequence: Synthetic peptide
YIVPSGGRTYYADSVKG

SEQ ID NO: 2065 - protein, 15 aa, Artificial Sequence
  Description of Artificial Sequence: Synthetic peptide
DRAYGDYVGWNGFDY

SEQ ID NO: 2066 - protein, 11 aa, Artificial Sequence
  Description of Artificial Sequence: Synthetic peptide
RASQNVHTYLA

SEQ ID NO: 2067 - protein, 7 aa, Artificial Sequence
  Description of Artificial Sequence: Synthetic peptide
EASNRAT

SEQ ID NO: 2068 - protein, 9 aa, Artificial Sequence
  Description of Artificial Sequence: Synthetic peptide
QQRGGWPIT

SEQ ID NO: 2069 - protein, 5 aa, Artificial Sequence
  Description of Artificial Sequence: Synthetic peptide
QYPMW

SEQ ID NO: 2070 - protein, 17 aa, Artificial Sequence
  Description of Artificial Sequence: Synthetic peptide
YIVPSGGRTYYADSVKG

SEQ ID NO: 2071 - protein, 15 aa, Artificial Sequence
  Description of Artificial Sequence: Synthetic peptide
DRAYGDYVGWNGFDY

SEQ ID NO: 2072 - protein, 11 aa, Artificial Sequence
  Description of Artificial Sequence: Synthetic peptide
RASQSISSFLA

SEQ ID NO: 2073 - protein, 7 aa, Artificial Sequence
  Description of Artificial Sequence: Synthetic peptide
DASYRAT

SEQ ID NO: 2074 - protein, 9 aa, Artificial Sequence
  Description of Artificial Sequence: Synthetic peptide
QQRGNWPIT

SEQ ID NO: 2075 - protein, 5 aa, Artificial Sequence
  Description of Artificial Sequence: Synthetic peptide
QYPMW

SEQ ID NO: 2076 - protein, 17 aa, Artificial Sequence
  Description of Artificial Sequence: Synthetic peptide
YIVPSGGRTYYADSVKG

SEQ ID NO: 2077 - protein, 15 aa, Artificial Sequence
  Description of Artificial Sequence: Synthetic peptide
DRAYGDYVGWNGFDY

SEQ ID NO: 2078 - protein, 12 aa, Artificial Sequence
  Description of Artificial Sequence: Synthetic peptide
RASQSLGRGDLA

SEQ ID NO: 2079 - protein, 7 aa, Artificial Sequence
  Description of Artificial Sequence: Synthetic peptide
GASSRAT

SEQ ID NO: 2080 - protein, 9 aa, Artificial Sequence
  Description of Artificial Sequence: Synthetic peptide
QQRSNWPPT

SEQ ID NO: 2081 - protein, 5 aa, Artificial Sequence
  Description of Artificial Sequence: Synthetic peptide
QYPMW

SEQ ID NO: 2082 - protein, 17 aa, Artificial Sequence
  Description of Artificial Sequence: Synthetic peptide
YIVPSGGRTYYADSVKG

SEQ ID NO: 2083 - protein, 15 aa, Artificial Sequence
  Description of Artificial Sequence: Synthetic peptide
DRAYGDYVGWNGFDY

SEQ ID NO: 2084 - protein, 12 aa, Artificial Sequence
  Description of Artificial Sequence: Synthetic peptide
RASQSLGRSDLA

SEQ ID NO: 2085 - protein, 7 aa, Artificial Sequence
  Description of Artificial Sequence: Synthetic peptide
GVSNRVT

SEQ ID NO: 2086 - protein, 9 aa, Artificial Sequence
  Description of Artificial Sequence: Synthetic peptide
QQRSNWPST

SEQ ID NO: 2087 - protein, 5 aa, Artificial Sequence
  Description of Artificial Sequence: Synthetic peptide
QYPMW

SEQ ID NO: 2088 - protein, 17 aa, Artificial Sequence
  Description of Artificial Sequence: Synthetic peptide
YIVPSGGRTYYADSVKG

SEQ ID NO: 2089 - protein, 15 aa, Artificial Sequence
  Description of Artificial Sequence: Synthetic peptide
DRAYGDYVGWNGFDY

SEQ ID NO: 2090 - protein, 12 aa, Artificial Sequence
  Description of Artificial Sequence: Synthetic peptide
RASQSLSGNYLA

SEQ ID NO: 2091 - protein, 7 aa, Artificial Sequence
  Description of Artificial Sequence: Synthetic peptide
GASSRAT

SEQ ID NO: 2092 - protein, 9 aa, Artificial Sequence
  Description of Artificial Sequence: Synthetic peptide
QQRSNWPIT

SEQ ID NO: 2093 - protein, 5 aa, Artificial Sequence
  Description of Artificial Sequence: Synthetic peptide
QYPMW

SEQ ID NO: 2094 - protein, 17 aa, Artificial Sequence
  Description of Artificial Sequence: Synthetic peptide
YIVPSGGRTYYADSVKG

SEQ ID NO: 2095 - protein, 15 aa, Artificial Sequence
  Description of Artificial Sequence: Synthetic peptide
DRAYGDYVGWNGFDY

SEQ ID NO: 2096 - protein, 11 aa, Artificial Sequence
  Description of Artificial Sequence: Synthetic peptide
RASQSVARYLA

SEQ ID NO: 2097 - protein, 7 aa, Artificial Sequence
  Description of Artificial Sequence: Synthetic peptide
GASRRGT

SEQ ID NO: 2098 - protein, 9 aa, Artificial Sequence
  Description of Artificial Sequence: Synthetic peptide
QQRRKWPVT

SEQ ID NO: 2099 - protein, 5 aa, Artificial Sequence
  Description of Artificial Sequence: Synthetic peptide
QYPMW

SEQ ID NO: 2100 - protein, 17 aa, Artificial Sequence
  Description of Artificial Sequence: Synthetic peptide
YIVPSGGRTYYADSVKG

SEQ ID NO: 2101 - protein, 15 aa, Artificial Sequence
  Description of Artificial Sequence: Synthetic peptide
DRAYGDYVGWNGFDY

SEQ ID NO: 2102 - protein, 11 aa, Artificial Sequence
  Description of Artificial Sequence: Synthetic peptide
RASQSVGADLA

SEQ ID NO: 2103 - protein, 7 aa, Artificial Sequence
  Description of Artificial Sequence: Synthetic peptide
HASTRAT

SEQ ID NO: 2104 - protein, 9 aa, Artificial Sequence
  Description of Artificial Sequence: Synthetic peptide
QQRGFWPIT

SEQ ID NO: 2105 - protein, 5 aa, Artificial Sequence
  Description of Artificial Sequence: Synthetic peptide
QYPMW

SEQ ID NO: 2106 - protein, 17 aa, Artificial Sequence
  Description of Artificial Sequence: Synthetic peptide
YIVPSGGRTYYADSVKG

SEQ ID NO: 2107 - protein, 15 aa, Artificial Sequence
  Description of Artificial Sequence: Synthetic peptide
DRAYGDYVGWNGFDY

SEQ ID NO: 2108 - protein, 11 aa, Artificial Sequence
  Description of Artificial Sequence: Synthetic peptide
RASQSVGSDLA

SEQ ID NO: 2109 - protein, 7 aa, Artificial Sequence
  Description of Artificial Sequence: Synthetic peptide
GASTRAT

SEQ ID NO: 2110 - protein, 9 aa, Artificial Sequence
  Description of Artificial Sequence: Synthetic peptide
QQRRSWPPT

SEQ ID NO: 2111 - protein, 5 aa, Artificial Sequence
  Description of Artificial Sequence: Synthetic peptide
QYPMW

SEQ ID NO: 2112 - protein, 17 aa, Artificial Sequence
  Description of Artificial Sequence: Synthetic peptide
YIVPSGGRTYYADSVKG

SEQ ID NO: 2113 - protein, 15 aa, Artificial Sequence
  Description of Artificial Sequence: Synthetic peptide
DRAYGDYVGWNGFDY

SEQ ID NO: 2114 - protein, 11 aa, Artificial Sequence
  Description of Artificial Sequence: Synthetic peptide
RASQSVGSDLA

SEQ ID NO: 2115 - protein, 7 aa, Artificial Sequence
  Description of Artificial Sequence: Synthetic peptide
GTSTRAT

SEQ ID NO: 2116 - protein, 9 aa, Artificial Sequence
  Description of Artificial Sequence: Synthetic peptide
QQRGNWPIT

SEQ ID NO: 2117 - protein, 5 aa, Artificial Sequence
  Description of Artificial Sequence: Synthetic peptide
QYPMW

SEQ ID NO: 2118 - protein, 17 aa, Artificial Sequence
  Description of Artificial Sequence: Synthetic peptide
YIVPSGGRTYYADSVKG

SEQ ID NO: 2119 - protein, 15 aa, Artificial Sequence
  Description of Artificial Sequence: Synthetic peptide
DRAYGDYVGWNGFDY

SEQ ID NO: 2120 - protein, 12 aa, Artificial Sequence
  Description of Artificial Sequence: Synthetic peptide
RASQSVGSNFLA

SEQ ID NO: 2121 - protein, 7 aa, Artificial Sequence
  Description of Artificial Sequence: Synthetic peptide
GASSRAS

SEQ ID NO: 2122 - protein, 9 aa, Artificial Sequence
  Description of Artificial Sequence: Synthetic peptide
QQRSSWPIT

SEQ ID NO: 2123 - protein, 5 aa, Artificial Sequence
  Description of Artificial Sequence: Synthetic peptide
QYPMW

SEQ ID NO: 2124 - protein, 17 aa, Artificial Sequence
  Description of Artificial Sequence: Synthetic peptide
YIVPSGGRTYYADSVKG

SEQ ID NO: 2125 - protein, 15 aa, Artificial Sequence
  Description of Artificial Sequence: Synthetic peptide
DRAYGDYVGWNGFDY

SEQ ID NO: 2126 - protein, 11 aa, Artificial Sequence
  Description of Artificial Sequence: Synthetic peptide
RASQSVNSNLA

SEQ ID NO: 2127 - protein, 7 aa, Artificial Sequence
  Description of Artificial Sequence: Synthetic peptide
EASNRAT

SEQ ID NO: 2128 - protein, 9 aa, Artificial Sequence
  Description of Artificial Sequence: Synthetic peptide
QQRAYWPVS

SEQ ID NO: 2129 - protein, 5 aa, Artificial Sequence
  Description of Artificial Sequence: Synthetic peptide
QYPMW

SEQ ID NO: 2130 - protein, 17 aa, Artificial Sequence
  Description of Artificial Sequence: Synthetic peptide
YIVPSGGRTYYADSVKG

SEQ ID NO: 2131 - protein, 15 aa, Artificial Sequence
  Description of Artificial Sequence: Synthetic peptide
DRAYGDYVGWNGFDY

SEQ ID NO: 2132 - protein, 11 aa, Artificial Sequence
  Description of Artificial Sequence: Synthetic peptide
RASQSVSRHLA

SEQ ID NO: 2133 - protein, 7 aa, Artificial Sequence
  Description of Artificial Sequence: Synthetic peptide
GASNRAT

SEQ ID NO: 2134 - protein, 9 aa, Artificial Sequence
  Description of Artificial Sequence: Synthetic peptide
QQRYNWPIT

SEQ ID NO: 2135 - protein, 5 aa, Artificial Sequence
  Description of Artificial Sequence: Synthetic peptide
QYPMW

SEQ ID NO: 2136 - protein, 17 aa, Artificial Sequence
  Description of Artificial Sequence: Synthetic peptide
YIVPSGGRTYYADSVKG

SEQ ID NO: 2137 - protein, 15 aa, Artificial Sequence
  Description of Artificial Sequence: Synthetic peptide
DRAYGDYVGWNGFDY

SEQ ID NO: 2138 - protein, 11 aa, Artificial Sequence
  Description of Artificial Sequence: Synthetic peptide
RASQSVSSDVA

SEQ ID NO: 2139 - protein, 7 aa, Artificial Sequence
  Description of Artificial Sequence: Synthetic peptide
GASARAT

SEQ ID NO: 2140 - protein, 9 aa, Artificial Sequence
  Description of Artificial Sequence: Synthetic peptide
QQRGNWPIT

SEQ ID NO: 2141 - protein, 5 aa, Artificial Sequence
  Description of Artificial Sequence: Synthetic peptide
QYPMW

SEQ ID NO: 2142 - protein, 17 aa, Artificial Sequence
  Description of Artificial Sequence: Synthetic peptide
YIVPSGGRTYYADSVKG

SEQ ID NO: 2143 - protein, 15 aa, Artificial Sequence
  Description of Artificial Sequence: Synthetic peptide
DRAYGDYVGWNGFDY

SEQ ID NO: 2144 - protein, 11 aa, Artificial Sequence
  Description of Artificial Sequence: Synthetic peptide
RASQSVSSNLA

SEQ ID NO: 2145 - protein, 7 aa, Artificial Sequence
  Description of Artificial Sequence: Synthetic peptide
DASYRAT

SEQ ID NO: 2146 - protein, 9 aa, Artificial Sequence
  Description of Artificial Sequence: Synthetic peptide
QQRGNWPIT

SEQ ID NO: 2147 - protein, 5 aa, Artificial Sequence
  Description of Artificial Sequence: Synthetic peptide
QYPMW

SEQ ID NO: 2148 - protein, 17 aa, Artificial Sequence
  Description of Artificial Sequence: Synthetic peptide
YIVPSGGRTYYADSVKG

SEQ ID NO: 2149 - protein, 15 aa, Artificial Sequence
  Description of Artificial Sequence: Synthetic peptide
DRAYGDYVGWNGFDY

SEQ ID NO: 2150 - protein, 12 aa, Artificial Sequence
  Description of Artificial Sequence: Synthetic peptide
RASQSVSSSHLA

SEQ ID NO: 2151 - protein, 7 aa, Artificial Sequence
  Description of Artificial Sequence: Synthetic peptide
GASNRAT

SEQ ID NO: 2152 - protein, 9 aa, Artificial Sequence
  Description of Artificial Sequence: Synthetic peptide
QQRRNWPPT

SEQ ID NO: 2153 - protein, 5 aa, Artificial Sequence
  Description of Artificial Sequence: Synthetic peptide
QYPMW

SEQ ID NO: 2154 - protein, 17 aa, Artificial Sequence
  Description of Artificial Sequence: Synthetic peptide
YIVPSGGRTYYADSVKG

SEQ ID NO: 2155 - protein, 15 aa, Artificial Sequence
  Description of Artificial Sequence: Synthetic peptide
DRAYGDYVGWNGFDY

SEQ ID NO: 2156 - protein, 12 aa, Artificial Sequence
  Description of Artificial Sequence: Synthetic peptide
RASQSVSSSQIA

SEQ ID NO: 2157 - protein, 7 aa, Artificial Sequence
  Description of Artificial Sequence: Synthetic peptide
GASYRAT

SEQ ID NO: 2158 - protein, 9 aa, Artificial Sequence
  Description of Artificial Sequence: Synthetic peptide
QQRSNWPVT

SEQ ID NO: 2159 - protein, 5 aa, Artificial Sequence
  Description of Artificial Sequence: Synthetic peptide
QYPMW

SEQ ID NO: 2160 - protein, 17 aa, Artificial Sequence
  Description of Artificial Sequence: Synthetic peptide
YIVPSGGRTYYADSVKG

SEQ ID NO: 2161 - protein, 15 aa, Artificial Sequence
  Description of Artificial Sequence: Synthetic peptide
DRAYGDYVGWNGFDY

SEQ ID NO: 2162 - protein, 12 aa, Artificial Sequence
  Description of Artificial Sequence: Synthetic peptide
RASQSVSSSQLA

SEQ ID NO: 2163 - protein, 7 aa, Artificial Sequence
  Description of Artificial Sequence: Synthetic peptide
GASNRAT

SEQ ID NO: 2164 - protein, 9 aa, Artificial Sequence
  Description of Artificial Sequence: Synthetic peptide
QQRSRWPIT

SEQ ID NO: 2165 - protein, 5 aa, Artificial Sequence
  Description of Artificial Sequence: Synthetic peptide
QYPMW

SEQ ID NO: 2166 - protein, 17 aa, Artificial Sequence
  Description of Artificial Sequence: Synthetic peptide
YIVPSGGRTYYADSVKG

SEQ ID NO: 2167 - protein, 15 aa, Artificial Sequence
  Description of Artificial Sequence: Synthetic peptide
DRAYGDYVGWNGFDY

SEQ ID NO: 2168 - protein, 12 aa, Artificial Sequence
  Description of Artificial Sequence: Synthetic peptide
RASQSVSSSQLA

SEQ ID NO: 2169 - protein, 7 aa, Artificial Sequence
  Description of Artificial Sequence: Synthetic peptide
GASNRAT

SEQ ID NO: 2170 - protein, 9 aa, Artificial Sequence
  Description of Artificial Sequence: Synthetic peptide
QQRSNWPVT

SEQ ID NO: 2171 - protein, 5 aa, Artificial Sequence
  Description of Artificial Sequence: Synthetic peptide
QYPMW

SEQ ID NO: 2172 - protein, 17 aa, Artificial Sequence
  Description of Artificial Sequence: Synthetic peptide
YIVPSGGRTYYADSVKG

SEQ ID NO: 2173 - protein, 15 aa, Artificial Sequence
  Description of Artificial Sequence: Synthetic peptide
DRAYGDYVGWNGFDY

SEQ ID NO: 2174 - protein, 12 aa, Artificial Sequence
  Description of Artificial Sequence: Synthetic peptide
RASQSVSSSQLA

SEQ ID NO: 2175 - protein, 7 aa, Artificial Sequence
  Description of Artificial Sequence: Synthetic peptide
GASSRAT

SEQ ID NO: 2176 - protein, 9 aa, Artificial Sequence
  Description of Artificial Sequence: Synthetic peptide
QQRGNWPIT

SEQ ID NO: 2177 - protein, 5 aa, Artificial Sequence
  Description of Artificial Sequence: Synthetic peptide
QYPMW

SEQ ID NO: 2178 - protein, 17 aa, Artificial Sequence
  Description of Artificial Sequence: Synthetic peptide
YIVPSGGRTYYADSVKG

SEQ ID NO: 2179 - protein, 15 aa, Artificial Sequence
  Description of Artificial Sequence: Synthetic peptide
DRAYGDYVGWNGFDY

SEQ ID NO: 2180 - protein, 12 aa, Artificial Sequence
  Description of Artificial Sequence: Synthetic peptide
RASQSVSSSQLA

SEQ ID NO: 2181 - protein, 7 aa, Artificial Sequence
  Description of Artificial Sequence: Synthetic peptide
GASNRAT

SEQ ID NO: 2182 - protein, 9 aa, Artificial Sequence
  Description of Artificial Sequence: Synthetic peptide
QQRSNWPVT

SEQ ID NO: 2183 - protein, 5 aa, Artificial Sequence
  Description of Artificial Sequence: Synthetic peptide
QYPMW

SEQ ID NO: 2184 - protein, 17 aa, Artificial Sequence
  Description of Artificial Sequence: Synthetic peptide
YIVPSGGRTYYADSVKG

SEQ ID NO: 2185 - protein, 15 aa, Artificial Sequence
  Description of Artificial Sequence: Synthetic peptide
DRAYGDYVGWNGFDY

SEQ ID NO: 2186 - protein, 12 aa, Artificial Sequence
  Description of Artificial Sequence: Synthetic peptide
RASQSVSSSYLA

SEQ ID NO: 2187 - protein, 7 aa, Artificial Sequence
  Description of Artificial Sequence: Synthetic peptide
DASSRAT

SEQ ID NO: 2188 - protein, 9 aa, Artificial Sequence
  Description of Artificial Sequence: Synthetic peptide
QQRHTWPIT

SEQ ID NO: 2189 - protein, 5 aa, Artificial Sequence
  Description of Artificial Sequence: Synthetic peptide
QYPMW

SEQ ID NO: 2190 - protein, 17 aa, Artificial Sequence
  Description of Artificial Sequence: Synthetic peptide
YIVPSGGRTYYADSVKG

SEQ ID NO: 2191 - protein, 15 aa, Artificial Sequence
  Description of Artificial Sequence: Synthetic peptide
DRAYGDYVGWNGFDY

SEQ ID NO: 2192 - protein, 11 aa, Artificial Sequence
  Description of Artificial Sequence: Synthetic peptide
RASQSVDNHLA

SEQ ID NO: 2193 - protein, 7 aa, Artificial Sequence
  Description of Artificial Sequence: Synthetic peptide
GASTRAT

SEQ ID NO: 2194 - protein, 9 aa, Artificial Sequence
  Description of Artificial Sequence: Synthetic peptide
QQRRKWPVT

SEQ ID NO: 2195 - protein, 5 aa, Artificial Sequence
  Description of Artificial Sequence: Synthetic peptide
QYPMW

SEQ ID NO: 2196 - protein, 17 aa, Artificial Sequence
  Description of Artificial Sequence: Synthetic peptide
YIVPSGGRTYYADSVKG

SEQ ID NO: 2197 - protein, 15 aa, Artificial Sequence
  Description of Artificial Sequence: Synthetic peptide
DRAYGDYVGWNGFDY

SEQ ID NO: 2198 - protein, 11 aa, Artificial Sequence
  Description of Artificial Sequence: Synthetic peptide
RASQPVGSYLA

SEQ ID NO: 2199 - protein, 7 aa, Artificial Sequence
  Description of Artificial Sequence: Synthetic peptide
GASNRAT

SEQ ID NO: 2200 - protein, 9 aa, Artificial Sequence
  Description of Artificial Sequence: Synthetic peptide
QQRSNWPIT

SEQ ID NO: 2201 - protein, 5 aa, Artificial Sequence
  Description of Artificial Sequence: Synthetic peptide
QYPMW

SEQ ID NO: 2202 - protein, 17 aa, Artificial Sequence
  Description of Artificial Sequence: Synthetic peptide
YIVPSGGRTYYADSVKG

SEQ ID NO: 2203 - protein, 15 aa, Artificial Sequence
  Description of Artificial Sequence: Synthetic peptide
DRAYGDYVGWNGFDY

SEQ ID NO: 2204 - protein, 12 aa, Artificial Sequence
  Description of Artificial Sequence: Synthetic peptide
RASQSLGRSDLA

SEQ ID NO: 2205 - protein, 7 aa, Artificial Sequence
  Description of Artificial Sequence: Synthetic peptide
GVSNRAT

SEQ ID NO: 2206 - protein, 9 aa, Artificial Sequence
  Description of Artificial Sequence: Synthetic peptide
QQRSNWPVT

SEQ ID NO: 2207 - protein, 5 aa, Artificial Sequence
  Description of Artificial Sequence: Synthetic peptide
QYPMW

SEQ ID NO: 2208 - protein, 17 aa, Artificial Sequence
  Description of Artificial Sequence: Synthetic peptide
YIVPSGGRTYYADSVKG

SEQ ID NO: 2209 - protein, 15 aa, Artificial Sequence
  Description of Artificial Sequence: Synthetic peptide
DRAYGDYVGWNGFDY

SEQ ID NO: 2210 - protein, 11 aa, Artificial Sequence
  Description of Artificial Sequence: Synthetic peptide
RASQSVSLYLA

SEQ ID NO: 2211 - protein, 7 aa, Artificial Sequence
  Description of Artificial Sequence: Synthetic peptide
GASSRAT

SEQ ID NO: 2212 - protein, 9 aa, Artificial Sequence
  Description of Artificial Sequence: Synthetic peptide
QQRGSWPIT

SEQ ID NO: 2213 - protein, 5 aa, Artificial Sequence
  Description of Artificial Sequence: Synthetic peptide
QYPMW

SEQ ID NO: 2214 - protein, 17 aa, Artificial Sequence
  Description of Artificial Sequence: Synthetic peptide
YIVPSGGRTYYADSVKG

SEQ ID NO: 2215 - protein, 15 aa, Artificial Sequence
  Description of Artificial Sequence: Synthetic peptide
DRAYGDYVGWNGFDY

SEQ ID NO: 2216 - protein, 11 aa, Artificial Sequence
  Description of Artificial Sequence: Synthetic peptide
RASQDVNRYLA

SEQ ID NO: 2217 - protein, 7 aa, Artificial Sequence
  Description of Artificial Sequence: Synthetic peptide
GASTRAT

SEQ ID NO: 2218 - protein, 9 aa, Artificial Sequence
  Description of Artificial Sequence: Synthetic peptide
QQRSNWPIT

SEQ ID NO: 2219 - protein, 5 aa, Artificial Sequence
  Description of Artificial Sequence: Synthetic peptide
QYPMW

SEQ ID NO: 2220 - protein, 17 aa, Artificial Sequence
  Description of Artificial Sequence: Synthetic peptide
YIVPSGGRTYYADSVKG

SEQ ID NO: 2221 - protein, 15 aa, Artificial Sequence
  Description of Artificial Sequence: Synthetic peptide
DRAYGDYVGWNGFDY

SEQ ID NO: 2222 - protein, 11 aa, Artificial Sequence
  Description of Artificial Sequence: Synthetic peptide
RASQSLNSDLA

SEQ ID NO: 2223 - protein, 7 aa, Artificial Sequence
  Description of Artificial Sequence: Synthetic peptide
GASTRAT

SEQ ID NO: 2224 - protein, 9 aa, Artificial Sequence
  Description of Artificial Sequence: Synthetic peptide
QQRRNWPIT

SEQ ID NO: 2225 - protein, 5 aa, Artificial Sequence
  Description of Artificial Sequence: Synthetic peptide
QYPMW

SEQ ID NO: 2226 - protein, 17 aa, Artificial Sequence
  Description of Artificial Sequence: Synthetic peptide
YIVPSGGRTYYADSVKG

SEQ ID NO: 2227 - protein, 15 aa, Artificial Sequence
  Description of Artificial Sequence: Synthetic peptide
DRAYGDYVGWNGFDY

SEQ ID NO: 2228 - protein, 11 aa, Artificial Sequence
  Description of Artificial Sequence: Synthetic peptide
RASQSVGSDLA

SEQ ID NO: 2229 - protein, 5 aa, Artificial Sequence
  Description of Artificial Sequence: Synthetic peptide
GASTR

SEQ ID NO: 2230 - protein, 9 aa, Artificial Sequence
  Description of Artificial Sequence: Synthetic peptide
QQRGNWPIT

SEQ ID NO: 2231 - protein, 5 aa, Artificial Sequence
  Description of Artificial Sequence: Synthetic peptide
QYPMW

SEQ ID NO: 2232 - protein, 17 aa, Artificial Sequence
  Description of Artificial Sequence: Synthetic peptide
YIVPSGGRTYYADSVKG

SEQ ID NO: 2233 - protein, 15 aa, Artificial Sequence
  Description of Artificial Sequence: Synthetic peptide
DRAYGDYVGWNGFDY

SEQ ID NO: 2234 - protein, 11 aa, Artificial Sequence
  Description of Artificial Sequence: Synthetic peptide
RASQSVSSNLA

SEQ ID NO: 2235 - protein, 7 aa, Artificial Sequence
  Description of Artificial Sequence: Synthetic peptide
GASTRAT

SEQ ID NO: 2236 - protein, 9 aa, Artificial Sequence
  Description of Artificial Sequence: Synthetic peptide
QQRGFWPIT

SEQ ID NO: 2237 - protein, 5 aa, Artificial Sequence
  Description of Artificial Sequence: Synthetic peptide
QYPMW

SEQ ID NO: 2238 - protein, 17 aa, Artificial Sequence
  Description of Artificial Sequence: Synthetic peptide
YIVPSGGRTYYADSVKG

SEQ ID NO: 2239 - protein, 15 aa, Artificial Sequence
  Description of Artificial Sequence: Synthetic peptide
DRAYGDYVGWNGFDY

SEQ ID NO: 2240 - protein, 11 aa, Artificial Sequence
  Description of Artificial Sequence: Synthetic peptide
RASQSVSSYLA

SEQ ID NO: 2241 - protein, 7 aa, Artificial Sequence
  Description of Artificial Sequence: Synthetic peptide
GASTRVT

SEQ ID NO: 2242 - protein, 9 aa, Artificial Sequence
  Description of Artificial Sequence: Synthetic peptide
QQRSSWPIT

SEQ ID NO: 2243 - protein, 5 aa, Artificial Sequence
  Description of Artificial Sequence: Synthetic peptide
QYPMW

SEQ ID NO: 2244 - protein, 17 aa, Artificial Sequence
  Description of Artificial Sequence: Synthetic peptide
YIVPSGGRTYYADSVKG

SEQ ID NO: 2245 - protein, 15 aa, Artificial Sequence
  Description of Artificial Sequence: Synthetic peptide
DRAYGDYVGWNGFDY

SEQ ID NO: 2246 - protein, 12 aa, Artificial Sequence
  Description of Artificial Sequence: Synthetic peptide
RASQTVSSRLLA

SEQ ID NO: 2247 - protein, 7 aa, Artificial Sequence
  Description of Artificial Sequence: Synthetic peptide
AASIRAT

SEQ ID NO: 2248 - protein, 9 aa, Artificial Sequence
  Description of Artificial Sequence: Synthetic peptide
QQRRSWPPT

SEQ ID NO: 2249 - protein, 5 aa, Artificial Sequence
  Description of Artificial Sequence: Synthetic peptide
QYPMW

SEQ ID NO: 2250 - protein, 17 aa, Artificial Sequence
  Description of Artificial Sequence: Synthetic peptide
YIVPSGGRTYYADSVKG

SEQ ID NO: 2251 - protein, 15 aa, Artificial Sequence
  Description of Artificial Sequence: Synthetic peptide
DRAYGDYVGWNGFDY

SEQ ID NO: 2252 - protein, 11 aa, Artificial Sequence
  Description of Artificial Sequence: Synthetic peptide
RATQGIGTFLA

SEQ ID NO: 2253 - protein, 7 aa, Artificial Sequence
  Description of Artificial Sequence: Synthetic peptide
GASTLQS

SEQ ID NO: 2254 - protein, 9 aa, Artificial Sequence
  Description of Artificial Sequence: Synthetic peptide
QQRGNWPIT

SEQ ID NO: 2255 - protein, 5 aa, Artificial Sequence
  Description of Artificial Sequence: Synthetic peptide
QYPMW

SEQ ID NO: 2256 - protein, 17 aa, Artificial Sequence
  Description of Artificial Sequence: Synthetic peptide
YIVPSGGRTYYADSVKG

SEQ ID NO: 2257 - protein, 15 aa, Artificial Sequence
  Description of Artificial Sequence: Synthetic peptide
DRAYGDYVGWNGFDY

SEQ ID NO: 2258 - protein, 11 aa, Artificial Sequence
  Description of Artificial Sequence: Synthetic peptide
RATQGIGTFLA

SEQ ID NO: 2259 - protein, 7 aa, Artificial Sequence
  Description of Artificial Sequence: Synthetic peptide
GASTLQS

SEQ ID NO: 2260 - protein, 9 aa, Artificial Sequence
  Description of Artificial Sequence: Synthetic peptide
QQRGNWPIT

SEQ ID NO: 2261 - protein, 5 aa, Artificial Sequence
  Description of Artificial Sequence: Synthetic peptide
QYPMW

SEQ ID NO: 2262 - protein, 17 aa, Artificial Sequence
  Description of Artificial Sequence: Synthetic peptide
YIVPSGGRTYYADSVKG

SEQ ID NO: 2263 - protein, 15 aa, Artificial Sequence
  Description of Artificial Sequence: Synthetic peptide
DRAYGDYVGWNGFDY

SEQ ID NO: 2264 - protein, 11 aa, Artificial Sequence
  Description of Artificial Sequence: Synthetic peptide
RASQDISSYLA

SEQ ID NO: 2265 - protein, 7 aa, Artificial Sequence
  Description of Artificial Sequence: Synthetic peptide
GASTLQS

SEQ ID NO: 2266 - protein, 9 aa, Artificial Sequence
  Description of Artificial Sequence: Synthetic peptide
QQRGNWPIT

SEQ ID NO: 2267 - protein, 5 aa, Artificial Sequence
  Description of Artificial Sequence: Synthetic peptide
QYPMW

SEQ ID NO: 2268 - protein, 17 aa, Artificial Sequence
  Description of Artificial Sequence: Synthetic peptide
YIVPSGGRTYYADSVKG

SEQ ID NO: 2269 - protein, 15 aa, Artificial Sequence
  Description of Artificial Sequence: Synthetic peptide
DRAYGDYVGWNGFDY

SEQ ID NO: 2270 - protein, 11 aa, Artificial Sequence
  Description of Artificial Sequence: Synthetic peptide
RASQGISSYLA

SEQ ID NO: 2271 - protein, 7 aa, Artificial Sequence
  Description of Artificial Sequence: Synthetic peptide
AASTLQS

SEQ ID NO: 2272 - protein, 9 aa, Artificial Sequence
  Description of Artificial Sequence: Synthetic peptide
QQRSNWPPS

SEQ ID NO: 2273 - protein, 5 aa, Artificial Sequence
  Description of Artificial Sequence: Synthetic peptide
QYPMW

SEQ ID NO: 2274 - protein, 17 aa, Artificial Sequence
  Description of Artificial Sequence: Synthetic peptide
YIVPSGGRTYYADSVKG

SEQ ID NO: 2275 - protein, 15 aa, Artificial Sequence
  Description of Artificial Sequence: Synthetic peptide
DRAYGDYVGWNGFDY

SEQ ID NO: 2276 - protein, 11 aa, Artificial Sequence
  Description of Artificial Sequence: Synthetic peptide
RASQGIRNDVG

SEQ ID NO: 2277 - protein, 7 aa, Artificial Sequence
  Description of Artificial Sequence: Synthetic peptide
APSNLQS

SEQ ID NO: 2278 - protein, 9 aa, Artificial Sequence
  Description of Artificial Sequence: Synthetic peptide
LQDFDFPWT

SEQ ID NO: 2279 - protein, 5 aa, Artificial Sequence
  Description of Artificial Sequence: Synthetic peptide
QYPMW

SEQ ID NO: 2280 - protein, 17 aa, Artificial Sequence
  Description of Artificial Sequence: Synthetic peptide
YIVPSGGRTYYADSVKG

SEQ ID NO: 2281 - protein, 15 aa, Artificial Sequence
  Description of Artificial Sequence: Synthetic peptide
DRAYGDYVGWNGFDY

SEQ ID NO: 2282 - protein, 11 aa, Artificial Sequence
  Description of Artificial Sequence: Synthetic peptide
RASQSISSFLA

SEQ ID NO: 2283 - protein, 7 aa, Artificial Sequence
  Description of Artificial Sequence: Synthetic peptide
DASYRAT

SEQ ID NO: 2284 - protein, 9 aa, Artificial Sequence
  Description of Artificial Sequence: Synthetic peptide
QQRGNWPIT

SEQ ID NO: 2285 - protein, 5 aa, Artificial Sequence
  Description of Artificial Sequence: Synthetic peptide
QYPMW

SEQ ID NO: 2286 - protein, 17 aa, Artificial Sequence
  Description of Artificial Sequence: Synthetic peptide
YIVPSGGRTYYADSVKG

SEQ ID NO: 2287 - protein, 15 aa, Artificial Sequence
  Description of Artificial Sequence: Synthetic peptide
DRAYGDYVGWNGFDY

SEQ ID NO: 2288 - protein, 11 aa, Artificial Sequence
  Description of Artificial Sequence: Synthetic peptide
RASQSVNSDLA

SEQ ID NO: 2289 - protein, 7 aa, Artificial Sequence
  Description of Artificial Sequence: Synthetic peptide
AASTRAT

SEQ ID NO: 2290 - protein, 9 aa, Artificial Sequence
  Description of Artificial Sequence: Synthetic peptide
QQRRKWPVT

SEQ ID NO: 2291 - protein, 5 aa, Artificial Sequence
  Description of Artificial Sequence: Synthetic peptide
QYPMW

SEQ ID NO: 2292 - protein, 17 aa, Artificial Sequence
  Description of Artificial Sequence: Synthetic peptide
YIVPSGGRTYYADSVKG

SEQ ID NO: 2293 - protein, 15 aa, Artificial Sequence
  Description of Artificial Sequence: Synthetic peptide
DRAYGDYVGWNGFDY

SEQ ID NO: 2294 - protein, 11 aa, Artificial Sequence
  Description of Artificial Sequence: Synthetic peptide
RASQGISTWLA

SEQ ID NO: 2295 - protein, 7 aa, Artificial Sequence
  Description of Artificial Sequence: Synthetic peptide
GASNRAT

SEQ ID NO: 2296 - protein, 9 aa, Artificial Sequence
  Description of Artificial Sequence: Synthetic peptide
QQRGNWPIT

SEQ ID NO: 2297 - protein, 5 aa, Artificial Sequence
  Description of Artificial Sequence: Synthetic peptide
QYPMW

SEQ ID NO: 2298 - protein, 17 aa, Artificial Sequence
  Description of Artificial Sequence: Synthetic peptide
YIVPSGGRTYYADSVKG

SEQ ID NO: 2299 - protein, 15 aa, Artificial Sequence
  Description of Artificial Sequence: Synthetic peptide
DRAYGDYVGWNGFDY

SEQ ID NO: 2300 - protein, 11 aa, Artificial Sequence
  Description of Artificial Sequence: Synthetic peptide
RASQTISSWLA

SEQ ID NO: 2301 - protein, 7 aa, Artificial Sequence
  Description of Artificial Sequence: Synthetic peptide
KASSLQS

SEQ ID NO: 2302 - protein, 8 aa, Artificial Sequence
  Description of Artificial Sequence: Synthetic peptide
QQYSSWYT

SEQ ID NO: 2303 - protein, 5 aa, Artificial Sequence
  Description of Artificial Sequence: Synthetic peptide
QYPMW

SEQ ID NO: 2304 - protein, 17 aa, Artificial Sequence
  Description of Artificial Sequence: Synthetic peptide
YIVPSGGRTYYADSVKG

SEQ ID NO: 2305 - protein, 15 aa, Artificial Sequence
  Description of Artificial Sequence: Synthetic peptide
DRAYGDYVGWNGFDY

SEQ ID NO: 2306 - protein, 11 aa, Artificial Sequence
  Description of Artificial Sequence: Synthetic peptide
RASQNVHTYLA

SEQ ID NO: 2307 - protein, 7 aa, Artificial Sequence
  Description of Artificial Sequence: Synthetic peptide
EASNRAT

SEQ ID NO: 2308 - protein, 9 aa, Artificial Sequence
  Description of Artificial Sequence: Synthetic peptide
QQRGGWPIT

SEQ ID NO: 2309 - protein, 5 aa, Artificial Sequence
  Description of Artificial Sequence: Synthetic peptide
QYPMW

SEQ ID NO: 2310 - protein, 17 aa, Artificial Sequence
  Description of Artificial Sequence: Synthetic peptide
YIVPSGGRTYYADSVKG

SEQ ID NO: 2311 - protein, 15 aa, Artificial Sequence
  Description of Artificial Sequence: Synthetic peptide
DRAYGDYVGWNGFDY

SEQ ID NO: 2312 - protein, 11 aa, Artificial Sequence
  Description of Artificial Sequence: Synthetic peptide
RASQNIGSDLA

SEQ ID NO: 2313 - protein, 7 aa, Artificial Sequence
  Description of Artificial Sequence: Synthetic peptide
RASFRAT

SEQ ID NO: 2314 - protein, 9 aa, Artificial Sequence
  Description of Artificial Sequence: Synthetic peptide
QQRGFWPLT

SEQ ID NO: 2315 - protein, 5 aa, Artificial Sequence
  Description of Artificial Sequence: Synthetic peptide
QYPMW

SEQ ID NO: 2316 - protein, 17 aa, Artificial Sequence
  Description of Artificial Sequence: Synthetic peptide
YIVPSGGRTYYADSVKG

SEQ ID NO: 2317 - protein, 15 aa, Artificial Sequence
  Description of Artificial Sequence: Synthetic peptide
DRAYGDYVGWNGFDY

SEQ ID NO: 2318 - protein, 11 aa, Artificial Sequence
  Description of Artificial Sequence: Synthetic peptide
RASQSISSFLA

SEQ ID NO: 2319 - protein, 7 aa, Artificial Sequence
  Description of Artificial Sequence: Synthetic peptide
DASYRAT

SEQ ID NO: 2320 - protein, 9 aa, Artificial Sequence
  Description of Artificial Sequence: Synthetic peptide
QQRGNWPIT

SEQ ID NO: 2321 - protein, 5 aa, Artificial Sequence
  Description of Artificial Sequence: Synthetic peptide
TYPMW

SEQ ID NO: 2322 - protein, 17 aa, Artificial Sequence
  Description of Artificial Sequence: Synthetic peptide
YISSSGGGTYYADSVKG

SEQ ID NO: 2323 - protein, 15 aa, Artificial Sequence
  Description of Artificial Sequence: Synthetic peptide
DRAYGDYVGWNGFDY

SEQ ID NO: 2324 - protein, 11 aa, Artificial Sequence
  Description of Artificial Sequence: Synthetic peptide
RASQSISSFLA

SEQ ID NO: 2325 - protein, 7 aa, Artificial Sequence
  Description of Artificial Sequence: Synthetic peptide
DASYRAT

SEQ ID NO: 2326 - protein, 9 aa, Artificial Sequence
  Description of Artificial Sequence: Synthetic peptide
QQRGNWPIT

SEQ ID NO: 2327 - protein, 5 aa, Artificial Sequence
  Description of Artificial Sequence: Synthetic peptide
AYDMI

SEQ ID NO: 2328 - protein, 17 aa, Artificial Sequence
  Description of Artificial Sequence: Synthetic peptide
YIVPSGGFTDYADSVKG

SEQ ID NO: 2329 - protein, 15 aa, Artificial Sequence
  Description of Artificial Sequence: Synthetic peptide
DRAYGDYVGWNGFDY

SEQ ID NO: 2330 - protein, 11 aa, Artificial Sequence
  Description of Artificial Sequence: Synthetic peptide
RASQSISSFLA

SEQ ID NO: 2331 - protein, 7 aa, Artificial Sequence
  Description of Artificial Sequence: Synthetic peptide
DASYRAT

SEQ ID NO: 2332 - protein, 9 aa, Artificial Sequence
  Description of Artificial Sequence: Synthetic peptide
QQRGNWPIT

SEQ ID NO: 2333 - protein, 5 aa, Artificial Sequence
  Description of Artificial Sequence: Synthetic peptide
AYDMW

SEQ ID NO: 2334 - protein, 17 aa, Artificial Sequence
  Description of Artificial Sequence: Synthetic peptide
VIYPSGGTTFYADSVKG

SEQ ID NO: 2335 - protein, 15 aa, Artificial Sequence
  Description of Artificial Sequence: Synthetic peptide
DRAYGDYVGWNGFDY

SEQ ID NO: 2336 - protein, 11 aa, Artificial Sequence
  Description of Artificial Sequence: Synthetic peptide
RASQSISSFLA

SEQ ID NO: 2337 - protein, 7 aa, Artificial Sequence
  Description of Artificial Sequence: Synthetic peptide
DASYRAT

SEQ ID NO: 2338 - protein, 9 aa, Artificial Sequence
  Description of Artificial Sequence: Synthetic peptide
QQRGNWPIT

SEQ ID NO: 2339 - protein, 5 aa, Artificial Sequence
  Description of Artificial Sequence: Synthetic peptide
AYDMW

SEQ ID NO: 2340 - protein, 17 aa, Artificial Sequence
  Description of Artificial Sequence: Synthetic peptide
VIYSSGGMTLYADSVKG

SEQ ID NO: 2341 - protein, 15 aa, Artificial Sequence
  Description of Artificial Sequence: Synthetic peptide
DRAYGDYVGWNGFDY

SEQ ID NO: 2342 - protein, 11 aa, Artificial Sequence
  Description of Artificial Sequence: Synthetic peptide
RASQSISSFLA

SEQ ID NO: 2343 - protein, 7 aa, Artificial Sequence
  Description of Artificial Sequence: Synthetic peptide
DASYRAT

SEQ ID NO: 2344 - protein, 9 aa, Artificial Sequence
  Description of Artificial Sequence: Synthetic peptide
QQRGNWPIT

SEQ ID NO: 2345 - protein, 5 aa, Artificial Sequence
  Description of Artificial Sequence: Synthetic peptide
AYDMW

SEQ ID NO: 2346 - protein, 17 aa, Artificial Sequence
  Description of Artificial Sequence: Synthetic peptide
YISSSGGFTDYADSVKG

SEQ ID NO: 2347 - protein, 15 aa, Artificial Sequence
  Description of Artificial Sequence: Synthetic peptide
DRAYGDYVGWNGFDY

SEQ ID NO: 2348 - protein, 11 aa, Artificial Sequence
  Description of Artificial Sequence: Synthetic peptide
RASQSISSFLA

SEQ ID NO: 2349 - protein, 7 aa, Artificial Sequence
  Description of Artificial Sequence: Synthetic peptide
DASYRAT

SEQ ID NO: 2350 - protein, 9 aa, Artificial Sequence
  Description of Artificial Sequence: Synthetic peptide
QQRGNWPIT

SEQ ID NO: 2351 - protein, 5 aa, Artificial Sequence
  Description of Artificial Sequence: Synthetic peptide
AYEMW

SEQ ID NO: 2352 - protein, 17 aa, Artificial Sequence
  Description of Artificial Sequence: Synthetic peptide
SIYPSGGYTDYADSVKG

SEQ ID NO: 2353 - protein, 15 aa, Artificial Sequence
  Description of Artificial Sequence: Synthetic peptide
DRAYGDYVGWNGFDY

SEQ ID NO: 2354 - protein, 11 aa, Artificial Sequence
  Description of Artificial Sequence: Synthetic peptide
RASQSISSFLA

SEQ ID NO: 2355 - protein, 7 aa, Artificial Sequence
  Description of Artificial Sequence: Synthetic peptide
DASYRAT

SEQ ID NO: 2356 - protein, 9 aa, Artificial Sequence
  Description of Artificial Sequence: Synthetic peptide
QQRGNWPIT

SEQ ID NO: 2357 - protein, 5 aa, Artificial Sequence
  Description of Artificial Sequence: Synthetic peptide
AYEMW

SEQ ID NO: 2358 - protein, 17 aa, Artificial Sequence
  Description of Artificial Sequence: Synthetic peptide
VIYPSGGGTFYADSVKG

SEQ ID NO: 2359 - protein, 15 aa, Artificial Sequence
  Description of Artificial Sequence: Synthetic peptide
DRAYGDYVGWNGFDY

SEQ ID NO: 2360 - protein, 11 aa, Artificial Sequence
  Description of Artificial Sequence: Synthetic peptide
RASQSISSFLA

SEQ ID NO: 2361 - protein, 7 aa, Artificial Sequence
  Description of Artificial Sequence: Synthetic peptide
DASYRAT

SEQ ID NO: 2362 - protein, 9 aa, Artificial Sequence
  Description of Artificial Sequence: Synthetic peptide
QQRGNWPIT

SEQ ID NO: 2363 - protein, 5 aa, Artificial Sequence
  Description of Artificial Sequence: Synthetic peptide
AYMMW

SEQ ID NO: 2364 - protein, 17 aa, Artificial Sequence
  Description of Artificial Sequence: Synthetic peptide
AISPSGGYTGYADSVKG

SEQ ID NO: 2365 - protein, 15 aa, Artificial Sequence
  Description of Artificial Sequence: Synthetic peptide
DRAYGDYVGWNGFDY

SEQ ID NO: 2366 - protein, 11 aa, Artificial Sequence
  Description of Artificial Sequence: Synthetic peptide
RASQSISSFLA

SEQ ID NO: 2367 - protein, 7 aa, Artificial Sequence
  Description of Artificial Sequence: Synthetic peptide
DASYRAT

SEQ ID NO: 2368 - protein, 9 aa, Artificial Sequence
  Description of Artificial Sequence: Synthetic peptide
QQRGNWPIT

SEQ ID NO: 2369 - protein, 5 aa, Artificial Sequence
  Description of Artificial Sequence: Synthetic peptide
AYNMI

SEQ ID NO: 2370 - protein, 17 aa, Artificial Sequence
  Description of Artificial Sequence: Synthetic peptide
YIVPSGGFTGYADSVKG

SEQ ID NO: 2371 - protein, 15 aa, Artificial Sequence
  Description of Artificial Sequence: Synthetic peptide
DRAYGDYVGWNGFDY

SEQ ID NO: 2372 - protein, 11 aa, Artificial Sequence
  Description of Artificial Sequence: Synthetic peptide
RASQSISSFLA

SEQ ID NO: 2373 - protein, 7 aa, Artificial Sequence
  Description of Artificial Sequence: Synthetic peptide
DASYRAT

SEQ ID NO: 2374 - protein, 9 aa, Artificial Sequence
  Description of Artificial Sequence: Synthetic peptide
QQRGNWPIT

SEQ ID NO: 2375 - protein, 5 aa, Artificial Sequence
  Description of Artificial Sequence: Synthetic peptide
AYPMI

SEQ ID NO: 2376 - protein, 17 aa, Artificial Sequence
  Description of Artificial Sequence: Synthetic peptide
YIVPSGGATFYADSVKG

SEQ ID NO: 2377 - protein, 15 aa, Artificial Sequence
  Description of Artificial Sequence: Synthetic peptide
DRAYGDYVGWNGFDY

SEQ ID NO: 2378 - protein, 11 aa, Artificial Sequence
  Description of Artificial Sequence: Synthetic peptide
RASQSISSFLA

SEQ ID NO: 2379 - protein, 7 aa, Artificial Sequence
  Description of Artificial Sequence: Synthetic peptide
DASYRAT

SEQ ID NO: 2380 - protein, 9 aa, Artificial Sequence
  Description of Artificial Sequence: Synthetic peptide
QQRGNWPIT

SEQ ID NO: 2381 - protein, 5 aa, Artificial Sequence
  Description of Artificial Sequence: Synthetic peptide
AYPMM

SEQ ID NO: 2382 - protein, 17 aa, Artificial Sequence
  Description of Artificial Sequence: Synthetic peptide
YIYPSGGGTFYADSVKG

SEQ ID NO: 2383 - protein, 15 aa, Artificial Sequence
  Description of Artificial Sequence: Synthetic peptide
DRAYGDYVGWNGFDY

SEQ ID NO: 2384 - protein, 11 aa, Artificial Sequence
  Description of Artificial Sequence: Synthetic peptide
RASQSISSFLA

SEQ ID NO: 2385 - protein, 7 aa, Artificial Sequence
  Description of Artificial Sequence: Synthetic peptide
DASYRAT

SEQ ID NO: 2386 - protein, 9 aa, Artificial Sequence
  Description of Artificial Sequence: Synthetic peptide
QQRGNWPIT

SEQ ID NO: 2387 - protein, 5 aa, Artificial Sequence
  Description of Artificial Sequence: Synthetic peptide
AYPMW

SEQ ID NO: 2388 - protein, 17 aa, Artificial Sequence
  Description of Artificial Sequence: Synthetic peptide
YIVPSGGMTYYADSVKG

SEQ ID NO: 2389 - protein, 15 aa, Artificial Sequence
  Description of Artificial Sequence: Synthetic peptide
DRAYGDYVGWNGFDY

SEQ ID NO: 2390 - protein, 11 aa, Artificial Sequence
  Description of Artificial Sequence: Synthetic peptide
RASQSISSFLA

SEQ ID NO: 2391 - protein, 7 aa, Artificial Sequence
  Description of Artificial Sequence: Synthetic peptide
DASYRAT

SEQ ID NO: 2392 - protein, 9 aa, Artificial Sequence
  Description of Artificial Sequence: Synthetic peptide
QQRGNWPIT

SEQ ID NO: 2393 - protein, 5 aa, Artificial Sequence
  Description of Artificial Sequence: Synthetic peptide
AYPMW

SEQ ID NO: 2394 - protein, 17 aa, Artificial Sequence
  Description of Artificial Sequence: Synthetic peptide
YIYPSGGATFYADSVKG

SEQ ID NO: 2395 - protein, 15 aa, Artificial Sequence
  Description of Artificial Sequence: Synthetic peptide
DRAYGDYVGWNGFDY

SEQ ID NO: 2396 - protein, 11 aa, Artificial Sequence
  Description of Artificial Sequence: Synthetic peptide
RASQSISSFLA

SEQ ID NO: 2397 - protein, 7 aa, Artificial Sequence
  Description of Artificial Sequence: Synthetic peptide
DASYRAT

SEQ ID NO: 2398 - protein, 9 aa, Artificial Sequence
  Description of Artificial Sequence: Synthetic peptide
QQRGNWPIT

SEQ ID NO: 2399 - protein, 5 aa, Artificial Sequence
  Description of Artificial Sequence: Synthetic peptide
DYAMW

SEQ ID NO: 2400 - protein, 17 aa, Artificial Sequence
  Description of Artificial Sequence: Synthetic peptide
SIYPSGGATFYADSVKG

SEQ ID NO: 2401 - protein, 15 aa, Artificial Sequence
  Description of Artificial Sequence: Synthetic peptide
DRAYGDYVGWNGFDY

SEQ ID NO: 2402 - protein, 11 aa, Artificial Sequence
  Description of Artificial Sequence: Synthetic peptide
RASQSISSFLA

SEQ ID NO: 2403 - protein, 7 aa, Artificial Sequence
  Description of Artificial Sequence: Synthetic peptide
DASYRAT

SEQ ID NO: 2404 - protein, 9 aa, Artificial Sequence
  Description of Artificial Sequence: Synthetic peptide
QQRGNWPIT

SEQ ID NO: 2405 - protein, 5 aa, Artificial Sequence
  Description of Artificial Sequence: Synthetic peptide
DYAMW

SEQ ID NO: 2406 - protein, 17 aa, Artificial Sequence
  Description of Artificial Sequence: Synthetic peptide
WISPSGGGTLYADSVKG

SEQ ID NO: 2407 - protein, 15 aa, Artificial Sequence
  Description of Artificial Sequence: Synthetic peptide
DRAYGDYVGWNGFDY

SEQ ID NO: 2408 - protein, 11 aa, Artificial Sequence
  Description of Artificial Sequence: Synthetic peptide
RASQSISSFLA

SEQ ID NO: 2409 - protein, 7 aa, Artificial Sequence
  Description of Artificial Sequence: Synthetic peptide
DASYRAT

SEQ ID NO: 2410 - protein, 9 aa, Artificial Sequence
  Description of Artificial Sequence: Synthetic peptide
QQRGNWPIT

SEQ ID NO: 2411 - protein, 5 aa, Artificial Sequence
  Description of Artificial Sequence: Synthetic peptide
DYDMF

SEQ ID NO: 2412 - protein, 17 aa, Artificial Sequence
  Description of Artificial Sequence: Synthetic peptide
GIVSSGGYTGYADSVKG

SEQ ID NO: 2413 - protein, 15 aa, Artificial Sequence
  Description of Artificial Sequence: Synthetic peptide
DRAYGDYVGWNGFDY

SEQ ID NO: 2414 - protein, 11 aa, Artificial Sequence
  Description of Artificial Sequence: Synthetic peptide
RASQSISSFLA

SEQ ID NO: 2415 - protein, 7 aa, Artificial Sequence
  Description of Artificial Sequence: Synthetic peptide
DASYRAT

SEQ ID NO: 2416 - protein, 9 aa, Artificial Sequence
  Description of Artificial Sequence: Synthetic peptide
QQRGNWPIT

SEQ ID NO: 2417 - protein, 5 aa, Artificial Sequence
  Description of Artificial Sequence: Synthetic peptide
DYDMW

SEQ ID NO: 2418 - protein, 17 aa, Artificial Sequence
  Description of Artificial Sequence: Synthetic peptide
VISPSGGYTGYADSVKG

SEQ ID NO: 2419 - protein, 15 aa, Artificial Sequence
  Description of Artificial Sequence: Synthetic peptide
DRAYGDYVGWNGFDY

SEQ ID NO: 2420 - protein, 11 aa, Artificial Sequence
  Description of Artificial Sequence: Synthetic peptide
RASQSISSFLA

SEQ ID NO: 2421 - protein, 7 aa, Artificial Sequence
  Description of Artificial Sequence: Synthetic peptide
DASYRAT

SEQ ID NO: 2422 - protein, 9 aa, Artificial Sequence
  Description of Artificial Sequence: Synthetic peptide
QQRGNWPIT

SEQ ID NO: 2423 - protein, 5 aa, Artificial Sequence
  Description of Artificial Sequence: Synthetic peptide
DYDMW

SEQ ID NO: 2424 - protein, 17 aa, Artificial Sequence
  Description of Artificial Sequence: Synthetic peptide
VIYPSGGFTGYADSVKG

SEQ ID NO: 2425 - protein, 15 aa, Artificial Sequence
  Description of Artificial Sequence: Synthetic peptide
DRAYGDYVGWNGFDY

SEQ ID NO: 2426 - protein, 11 aa, Artificial Sequence
  Description of Artificial Sequence: Synthetic peptide
RASQSISSFLA

SEQ ID NO: 2427 - protein, 7 aa, Artificial Sequence
  Description of Artificial Sequence: Synthetic peptide
DASYRAT

SEQ ID NO: 2428 - protein, 9 aa, Artificial Sequence
  Description of Artificial Sequence: Synthetic peptide
QQRGNWPIT

SEQ ID NO: 2429 - protein, 5 aa, Artificial Sequence
  Description of Artificial Sequence: Synthetic peptide
DYDMW

SEQ ID NO: 2430 - protein, 16 aa, Artificial Sequence
  Description of Artificial Sequence: Synthetic peptide
VIYSGGSTYYADSVKG

SEQ ID NO: 2431 - protein, 15 aa, Artificial Sequence
  Description of Artificial Sequence: Synthetic peptide
DRAYGDYVGWNGFDY

SEQ ID NO: 2432 - protein, 11 aa, Artificial Sequence
  Description of Artificial Sequence: Synthetic peptide
RASQSISSFLA

SEQ ID NO: 2433 - protein, 7 aa, Artificial Sequence
  Description of Artificial Sequence: Synthetic peptide
DASYRAT

SEQ ID NO: 2434 - protein, 9 aa, Artificial Sequence
  Description of Artificial Sequence: Synthetic peptide
QQRGNWPIT

SEQ ID NO: 2435 - protein, 5 aa, Artificial Sequence
  Description of Artificial Sequence: Synthetic peptide
DYDMW

SEQ ID NO: 2436 - protein, 17 aa, Artificial Sequence
  Description of Artificial Sequence: Synthetic peptide
VIYSSGGFTSYADSVKG

SEQ ID NO: 2437 - protein, 15 aa, Artificial Sequence
  Description of Artificial Sequence: Synthetic peptide
DRAYGDYVGWNGFDY

SEQ ID NO: 2438 - protein, 11 aa, Artificial Sequence
  Description of Artificial Sequence: Synthetic peptide
RASQSISSFLA

SEQ ID NO: 2439 - protein, 7 aa, Artificial Sequence
  Description of Artificial Sequence: Synthetic peptide
DASYRAT

SEQ ID NO: 2440 - protein, 9 aa, Artificial Sequence
  Description of Artificial Sequence: Synthetic peptide
QQRGNWPIT

SEQ ID NO: 2441 - protein, 5 aa, Artificial Sequence
  Description of Artificial Sequence: Synthetic peptide
DYDMW

SEQ ID NO: 2442 - protein, 17 aa, Artificial Sequence
  Description of Artificial Sequence: Synthetic peptide
VIYSSGGMTYYADSVKG

SEQ ID NO: 2443 - protein, 15 aa, Artificial Sequence
  Description of Artificial Sequence: Synthetic peptide
DRAYGDYVGWNGFDY

SEQ ID NO: 2444 - protein, 11 aa, Artificial Sequence
  Description of Artificial Sequence: Synthetic peptide
RASQSISSFLA

SEQ ID NO: 2445 - protein, 7 aa, Artificial Sequence
  Description of Artificial Sequence: Synthetic peptide
DASYRAT

SEQ ID NO: 2446 - protein, 9 aa, Artificial Sequence
  Description of Artificial Sequence: Synthetic peptide
QQRGNWPIT

SEQ ID NO: 2447 - protein, 5 aa, Artificial Sequence
  Description of Artificial Sequence: Synthetic peptide
DYMMW

SEQ ID NO: 2448 - protein, 17 aa, Artificial Sequence
  Description of Artificial Sequence: Synthetic peptide
SISPSGGFTDYADSVKG

SEQ ID NO: 2449 - protein, 15 aa, Artificial Sequence
  Description of Artificial Sequence: Synthetic peptide
DRAYGDYVGWNGFDY

SEQ ID NO: 2450 - protein, 11 aa, Artificial Sequence
  Description of Artificial Sequence: Synthetic peptide
RASQSISSFLA

SEQ ID NO: 2451 - protein, 7 aa, Artificial Sequence
  Description of Artificial Sequence: Synthetic peptide
DASYRAT

SEQ ID NO: 2452 - protein, 9 aa, Artificial Sequence
  Description of Artificial Sequence: Synthetic peptide
QQRGNWPIT

SEQ ID NO: 2453 - protein, 5 aa, Artificial Sequence
  Description of Artificial Sequence: Synthetic peptide
DYNMW

SEQ ID NO: 2454 - protein, 17 aa, Artificial Sequence
  Description of Artificial Sequence: Synthetic peptide
VIYPSGGWTMYADSVKG

SEQ ID NO: 2455 - protein, 15 aa, Artificial Sequence
  Description of Artificial Sequence: Synthetic peptide
DRAYGDYVGWNGFDY

SEQ ID NO: 2456 - protein, 11 aa, Artificial Sequence
  Description of Artificial Sequence: Synthetic peptide
RASQSISSFLA

SEQ ID NO: 2457 - protein, 7 aa, Artificial Sequence
  Description of Artificial Sequence: Synthetic peptide
DASYRAT

SEQ ID NO: 2458 - protein, 9 aa, Artificial Sequence
  Description of Artificial Sequence: Synthetic peptide
QQRGNWPIT

SEQ ID NO: 2459 - protein, 5 aa, Artificial Sequence
  Description of Artificial Sequence: Synthetic peptide
DYPMF

SEQ ID NO: 2460 - protein, 17 aa, Artificial Sequence
  Description of Artificial Sequence: Synthetic peptide
YIVPSGGWTDYADSVKG

SEQ ID NO: 2461 - protein, 15 aa, Artificial Sequence
  Description of Artificial Sequence: Synthetic peptide
DRAYGDYVGWNGFDY

SEQ ID NO: 2462 - protein, 11 aa, Artificial Sequence
  Description of Artificial Sequence: Synthetic peptide
RASQSISSFLA

SEQ ID NO: 2463 - protein, 7 aa, Artificial Sequence
  Description of Artificial Sequence: Synthetic peptide
DASYRAT

SEQ ID NO: 2464 - protein, 9 aa, Artificial Sequence
  Description of Artificial Sequence: Synthetic peptide
QQRGNWPIT

SEQ ID NO: 2465 - protein, 5 aa, Artificial Sequence
  Description of Artificial Sequence: Synthetic peptide
DYPMF

SEQ ID NO: 2466 - protein, 17 aa, Artificial Sequence
  Description of Artificial Sequence: Synthetic peptide
YIVPSGGWTSYADSVKG

SEQ ID NO: 2467 - protein, 15 aa, Artificial Sequence
  Description of Artificial Sequence: Synthetic peptide
DRAYGDYVGWNGFDY

SEQ ID NO: 2468 - protein, 11 aa, Artificial Sequence
  Description of Artificial Sequence: Synthetic peptide
RASQSISSFLA

SEQ ID NO: 2469 - protein, 7 aa, Artificial Sequence
  Description of Artificial Sequence: Synthetic peptide
DASYRAT

SEQ ID NO: 2470 - protein, 9 aa, Artificial Sequence
  Description of Artificial Sequence: Synthetic peptide
QQRGNWPIT

SEQ ID NO: 2471 - protein, 5 aa, Artificial Sequence
  Description of Artificial Sequence: Synthetic peptide
DYPMI

SEQ ID NO: 2472 - protein, 17 aa, Artificial Sequence
  Description of Artificial Sequence: Synthetic peptide
YISPSGGYTDYADSVKG

SEQ ID NO: 2473 - protein, 15 aa, Artificial Sequence
  Description of Artificial Sequence: Synthetic peptide
DRAYGDYVGWNGFDY

SEQ ID NO: 2474 - protein, 11 aa, Artificial Sequence
  Description of Artificial Sequence: Synthetic peptide
RASQSISSFLA

SEQ ID NO: 2475 - protein, 7 aa, Artificial Sequence
  Description of Artificial Sequence: Synthetic peptide
DASYRAT

SEQ ID NO: 2476 - protein, 9 aa, Artificial Sequence
  Description of Artificial Sequence: Synthetic peptide
QQRGNWPIT

SEQ ID NO: 2477 - protein, 5 aa, Artificial Sequence
  Description of Artificial Sequence: Synthetic peptide
DYPMI

SEQ ID NO: 2478 - protein, 17 aa, Artificial Sequence
  Description of Artificial Sequence: Synthetic peptide
YIVPSGGWTDYADSVKG

SEQ ID NO: 2479 - protein, 15 aa, Artificial Sequence
  Description of Artificial Sequence: Synthetic peptide
DRAYGDYVGWNGFDY

SEQ ID NO: 2480 - protein, 11 aa, Artificial Sequence
  Description of Artificial Sequence: Synthetic peptide
RASQSISSFLA

SEQ ID NO: 2481 - protein, 7 aa, Artificial Sequence
  Description of Artificial Sequence: Synthetic peptide
DASYRAT

SEQ ID NO: 2482 - protein, 9 aa, Artificial Sequence
  Description of Artificial Sequence: Synthetic peptide
QQRGNWPIT

SEQ ID NO: 2483 - protein, 5 aa, Artificial Sequence
  Description of Artificial Sequence: Synthetic peptide
DYPMI

SEQ ID NO: 2484 - protein, 17 aa, Artificial Sequence
  Description of Artificial Sequence: Synthetic peptide
YIYPSGGGTYYADSVKG

SEQ ID NO: 2485 - protein, 15 aa, Artificial Sequence
  Description of Artificial Sequence: Synthetic peptide
DRAYGDYVGWNGFDY

SEQ ID NO: 2486 - protein, 11 aa, Artificial Sequence
  Description of Artificial Sequence: Synthetic peptide
RASQSISSFLA

SEQ ID NO: 2487 - protein, 7 aa, Artificial Sequence
  Description of Artificial Sequence: Synthetic peptide
DASYRAT

SEQ ID NO: 2488 - protein, 9 aa, Artificial Sequence
  Description of Artificial Sequence: Synthetic peptide
QQRGNWPIT

SEQ ID NO: 2489 - protein, 5 aa, Artificial Sequence
  Description of Artificial Sequence: Synthetic peptide
DYPMW

SEQ ID NO: 2490 - protein, 17 aa, Artificial Sequence
  Description of Artificial Sequence: Synthetic peptide
YISSSGGWTSYADSVKG

SEQ ID NO: 2491 - protein, 15 aa, Artificial Sequence
  Description of Artificial Sequence: Synthetic peptide
DRAYGDYVGWNGFDY

SEQ ID NO: 2492 - protein, 11 aa, Artificial Sequence
  Description of Artificial Sequence: Synthetic peptide
RASQSISSFLA

SEQ ID NO: 2493 - protein, 7 aa, Artificial Sequence
  Description of Artificial Sequence: Synthetic peptide
DASYRAT

SEQ ID NO: 2494 - protein, 9 aa, Artificial Sequence
  Description of Artificial Sequence: Synthetic peptide
QQRGNWPIT

SEQ ID NO: 2495 - protein, 5 aa, Artificial Sequence
  Description of Artificial Sequence: Synthetic peptide
DYPMW

SEQ ID NO: 2496 - protein, 17 aa, Artificial Sequence
  Description of Artificial Sequence: Synthetic peptide
YIYPSGGATYYADSVKG

SEQ ID NO: 2497 - protein, 15 aa, Artificial Sequence
  Description of Artificial Sequence: Synthetic peptide
DRAYGDYVGWNGFDY

SEQ ID NO: 2498 - protein, 11 aa, Artificial Sequence
  Description of Artificial Sequence: Synthetic peptide
RASQSISSFLA

SEQ ID NO: 2499 - protein, 7 aa, Artificial Sequence
  Description of Artificial Sequence: Synthetic peptide
DASYRAT

SEQ ID NO: 2500 - protein, 9 aa, Artificial Sequence
  Description of Artificial Sequence: Synthetic peptide
QQRGNWPIT

SEQ ID NO: 2501 - protein, 5 aa, Artificial Sequence
  Description of Artificial Sequence: Synthetic peptide
DYQMW

SEQ ID NO: 2502 - protein, 17 aa, Artificial Sequence
  Description of Artificial Sequence: Synthetic peptide
VIYPSGGATFYADSVKG

SEQ ID NO: 2503 - protein, 15 aa, Artificial Sequence
  Description of Artificial Sequence: Synthetic peptide
DRAYGDYVGWNGFDY

SEQ ID NO: 2504 - protein, 11 aa, Artificial Sequence
  Description of Artificial Sequence: Synthetic peptide
RASQSISSFLA

SEQ ID NO: 2505 - protein, 7 aa, Artificial Sequence
  Description of Artificial Sequence: Synthetic peptide
DASYRAT

SEQ ID NO: 2506 - protein, 9 aa, Artificial Sequence
  Description of Artificial Sequence: Synthetic peptide
QQRGNWPIT

SEQ ID NO: 2507 - protein, 5 aa, Artificial Sequence
  Description of Artificial Sequence: Synthetic peptide
EYDMW

SEQ ID NO: 2508 - protein, 17 aa, Artificial Sequence
  Description of Artificial Sequence: Synthetic peptide
VIYPSGGPTYYADSVKG

SEQ ID NO: 2509 - protein, 15 aa, Artificial Sequence
  Description of Artificial Sequence: Synthetic peptide
DRAYGDYVGWNGFDY

SEQ ID NO: 2510 - protein, 11 aa, Artificial Sequence
  Description of Artificial Sequence: Synthetic peptide
RASQSISSFLA

SEQ ID NO: 2511 - protein, 7 aa, Artificial Sequence
  Description of Artificial Sequence: Synthetic peptide
DASYRAT

SEQ ID NO: 2512 - protein, 9 aa, Artificial Sequence
  Description of Artificial Sequence: Synthetic peptide
QQRGNWPIT

SEQ ID NO: 2513 - protein, 5 aa, Artificial Sequence
  Description of Artificial Sequence: Synthetic peptide
EYDMW

SEQ ID NO: 2514 - protein, 17 aa, Artificial Sequence
  Description of Artificial Sequence: Synthetic peptide
VIYSSGGYTGYADSVKG

SEQ ID NO: 2515 - protein, 15 aa, Artificial Sequence
  Description of Artificial Sequence: Synthetic peptide
DRAYGDYVGWNGFDY

SEQ ID NO: 2516 - protein, 11 aa, Artificial Sequence
  Description of Artificial Sequence: Synthetic peptide
RASQSISSFLA

SEQ ID NO: 2517 - protein, 7 aa, Artificial Sequence
  Description of Artificial Sequence: Synthetic peptide
DASYRAT

SEQ ID NO: 2518 - protein, 9 aa, Artificial Sequence
  Description of Artificial Sequence: Synthetic peptide
QQRGNWPIT

SEQ ID NO: 2519 - protein, 5 aa, Artificial Sequence
  Description of Artificial Sequence: Synthetic peptide
EYEMW

SEQ ID NO: 2520 - protein, 17 aa, Artificial Sequence
  Description of Artificial Sequence: Synthetic peptide
VIYPSGGYTNYADSVKG

SEQ ID NO: 2521 - protein, 15 aa, Artificial Sequence
  Description of Artificial Sequence: Synthetic peptide
DRAYGDYVGWNGFDY

SEQ ID NO: 2522 - protein, 11 aa, Artificial Sequence
  Description of Artificial Sequence: Synthetic peptide
RASQSISSFLA

SEQ ID NO: 2523 - protein, 7 aa, Artificial Sequence
  Description of Artificial Sequence: Synthetic peptide
DASYRAT

SEQ ID NO: 2524 - protein, 9 aa, Artificial Sequence
  Description of Artificial Sequence: Synthetic peptide
QQRGNWPIT

SEQ ID NO: 2525 - protein, 5 aa, Artificial Sequence
  Description of Artificial Sequence: Synthetic peptide
EYNMW

SEQ ID NO: 2526 - protein, 17 aa, Artificial Sequence
  Description of Artificial Sequence: Synthetic peptide
VIYPSGGPTWYADSVKG

SEQ ID NO: 2527 - protein, 15 aa, Artificial Sequence
  Description of Artificial Sequence: Synthetic peptide
DRAYGDYVGWNGFDY

SEQ ID NO: 2528 - protein, 11 aa, Artificial Sequence
  Description of Artificial Sequence: Synthetic peptide
RASQSISSFLA

SEQ ID NO: 2529 - protein, 7 aa, Artificial Sequence
  Description of Artificial Sequence: Synthetic peptide
DASYRAT

SEQ ID NO: 2530 - protein, 9 aa, Artificial Sequence
  Description of Artificial Sequence: Synthetic peptide
QQRGNWPIT

SEQ ID NO: 2531 - protein, 5 aa, Artificial Sequence
  Description of Artificial Sequence: Synthetic peptide
EYPMF

SEQ ID NO: 2532 - protein, 17 aa, Artificial Sequence
  Description of Artificial Sequence: Synthetic peptide
YISPSGGWTSYADSVKG

SEQ ID NO: 2533 - protein, 15 aa, Artificial Sequence
  Description of Artificial Sequence: Synthetic peptide
DRAYGDYVGWNGFDY

SEQ ID NO: 2534 - protein, 11 aa, Artificial Sequence
  Description of Artificial Sequence: Synthetic peptide
RASQSISSFLA

SEQ ID NO: 2535 - protein, 7 aa, Artificial Sequence
  Description of Artificial Sequence: Synthetic peptide
DASYRAT

SEQ ID NO: 2536 - protein, 9 aa, Artificial Sequence
  Description of Artificial Sequence: Synthetic peptide
QQRGNWPIT

SEQ ID NO: 2537 - protein, 5 aa, Artificial Sequence
  Description of Artificial Sequence: Synthetic peptide
EYPMI

SEQ ID NO: 2538 - protein, 17 aa, Artificial Sequence
  Description of Artificial Sequence: Synthetic peptide
YISPSGGYTGYADSVKG

SEQ ID NO: 2539 - protein, 15 aa, Artificial Sequence
  Description of Artificial Sequence: Synthetic peptide
DRAYGDYVGWNGFDY

SEQ ID NO: 2540 - protein, 11 aa, Artificial Sequence
  Description of Artificial Sequence: Synthetic peptide
RASQSISSFLA

SEQ ID NO: 2541 - protein, 7 aa, Artificial Sequence
  Description of Artificial Sequence: Synthetic peptide
DASYRAT

SEQ ID NO: 2542 - protein, 9 aa, Artificial Sequence
  Description of Artificial Sequence: Synthetic peptide
QQRGNWPIT

SEQ ID NO: 2543 - protein, 5 aa, Artificial Sequence
  Description of Artificial Sequence: Synthetic peptide
EYPMW

SEQ ID NO: 2544 - protein, 17 aa, Artificial Sequence
  Description of Artificial Sequence: Synthetic peptide
SIYPSGGATFYADSVKG

SEQ ID NO: 2545 - protein, 15 aa, Artificial Sequence
  Description of Artificial Sequence: Synthetic peptide
DRAYGDYVGWNGFDY

SEQ ID NO: 2546 - protein, 11 aa, Artificial Sequence
  Description of Artificial Sequence: Synthetic peptide
RASQSISSFLA

SEQ ID NO: 2547 - protein, 7 aa, Artificial Sequence
  Description of Artificial Sequence: Synthetic peptide
DASYRAT

SEQ ID NO: 2548 - protein, 9 aa, Artificial Sequence
  Description of Artificial Sequence: Synthetic peptide
QQRGNWPIT

SEQ ID NO: 2549 - protein, 5 aa, Artificial Sequence
  Description of Artificial Sequence: Synthetic peptide
EYWMW

SEQ ID NO: 2550 - protein, 17 aa, Artificial Sequence
  Description of Artificial Sequence: Synthetic peptide
SISPSGGGTFYADSVKG

SEQ ID NO: 2551 - protein, 15 aa, Artificial Sequence
  Description of Artificial Sequence: Synthetic peptide
DRAYGDYVGWNGFDY

SEQ ID NO: 2552 - protein, 11 aa, Artificial Sequence
  Description of Artificial Sequence: Synthetic peptide
RASQSISSFLA

SEQ ID NO: 2553 - protein, 7 aa, Artificial Sequence
  Description of Artificial Sequence: Synthetic peptide
DASYRAT

SEQ ID NO: 2554 - protein, 9 aa, Artificial Sequence
  Description of Artificial Sequence: Synthetic peptide
QQRGNWPIT

SEQ ID NO: 2555 - protein, 5 aa, Artificial Sequence
  Description of Artificial Sequence: Synthetic peptide
FYDMF

SEQ ID NO: 2556 - protein, 17 aa, Artificial Sequence
  Description of Artificial Sequence: Synthetic peptide
VISSSGGGTFYADSVKG

SEQ ID NO: 2557 - protein, 15 aa, Artificial Sequence
  Description of Artificial Sequence: Synthetic peptide
DRAYGDYVGWNGFDY

SEQ ID NO: 2558 - protein, 11 aa, Artificial Sequence
  Description of Artificial Sequence: Synthetic peptide
RASQSISSFLA

SEQ ID NO: 2559 - protein, 7 aa, Artificial Sequence
  Description of Artificial Sequence: Synthetic peptide
DASYRAT

SEQ ID NO: 2560 - protein, 9 aa, Artificial Sequence
  Description of Artificial Sequence: Synthetic peptide
QQRGNWPIT

SEQ ID NO: 2561 - protein, 5 aa, Artificial Sequence
  Description of Artificial Sequence: Synthetic peptide
FYDML

SEQ ID NO: 2562 - protein, 17 aa, Artificial Sequence
  Description of Artificial Sequence: Synthetic peptide
YISSSGGFTGYADSVKG

SEQ ID NO: 2563 - protein, 15 aa, Artificial Sequence
  Description of Artificial Sequence: Synthetic peptide
DRAYGDYVGWNGFDY

SEQ ID NO: 2564 - protein, 11 aa, Artificial Sequence
  Description of Artificial Sequence: Synthetic peptide
RASQSISSFLA

SEQ ID NO: 2565 - protein, 7 aa, Artificial Sequence
  Description of Artificial Sequence: Synthetic peptide
DASYRAT

SEQ ID NO: 2566 - protein, 9 aa, Artificial Sequence
  Description of Artificial Sequence: Synthetic peptide
QQRGNWPIT

SEQ ID NO: 2567 - protein, 5 aa, Artificial Sequence
  Description of Artificial Sequence: Synthetic peptide
FYDMW

SEQ ID NO: 2568 - protein, 17 aa, Artificial Sequence
  Description of Artificial Sequence: Synthetic peptide
SIYSSGGATFYADSVKG

SEQ ID NO: 2569 - protein, 15 aa, Artificial Sequence
  Description of Artificial Sequence: Synthetic peptide
DRAYGDYVGWNGFDY

SEQ ID NO: 2570 - protein, 11 aa, Artificial Sequence
  Description of Artificial Sequence: Synthetic peptide
RASQSISSFLA

SEQ ID NO: 2571 - protein, 7 aa, Artificial Sequence
  Description of Artificial Sequence: Synthetic peptide
DASYRAT

SEQ ID NO: 2572 - protein, 9 aa, Artificial Sequence
  Description of Artificial Sequence: Synthetic peptide
QQRGNWPIT

SEQ ID NO: 2573 - protein, 5 aa, Artificial Sequence
  Description of Artificial Sequence: Synthetic peptide
FYDMW

SEQ ID NO: 2574 - protein, 17 aa, Artificial Sequence
  Description of Artificial Sequence: Synthetic peptide
VIYSSGGATFYADSVKG

SEQ ID NO: 2575 - protein, 15 aa, Artificial Sequence
  Description of Artificial Sequence: Synthetic peptide
DRAYGDYVGWNGFDY

SEQ ID NO: 2576 - protein, 11 aa, Artificial Sequence
  Description of Artificial Sequence: Synthetic peptide
RASQSISSFLA

SEQ ID NO: 2577 - protein, 7 aa, Artificial Sequence
  Description of Artificial Sequence: Synthetic peptide
DASYRAT

SEQ ID NO: 2578 - protein, 9 aa, Artificial Sequence
  Description of Artificial Sequence: Synthetic peptide
QQRGNWPIT

SEQ ID NO: 2579 - protein, 5 aa, Artificial Sequence
  Description of Artificial Sequence: Synthetic peptide
FYDMW

SEQ ID NO: 2580 - protein, 17 aa, Artificial Sequence
  Description of Artificial Sequence: Synthetic peptide
VIYSSGGFTDYADSVKG

SEQ ID NO: 2581 - protein, 15 aa, Artificial Sequence
  Description of Artificial Sequence: Synthetic peptide
DRAYGDYVGWNGFDY

SEQ ID NO: 2582 - protein, 11 aa, Artificial Sequence
  Description of Artificial Sequence: Synthetic peptide
RASQSISSFLA

SEQ ID NO: 2583 - protein, 7 aa, Artificial Sequence
  Description of Artificial Sequence: Synthetic peptide
DASYRAT

SEQ ID NO: 2584 - protein, 9 aa, Artificial Sequence
  Description of Artificial Sequence: Synthetic peptide
QQRGNWPIT

SEQ ID NO: 2585 - protein, 5 aa, Artificial Sequence
  Description of Artificial Sequence: Synthetic peptide
FYDMW

SEQ ID NO: 2586 - protein, 17 aa, Artificial Sequence
  Description of Artificial Sequence: Synthetic peptide
YISSSGGGTFYADSVKG

SEQ ID NO: 2587 - protein, 15 aa, Artificial Sequence
  Description of Artificial Sequence: Synthetic peptide
DRAYGDYVGWNGFDY

SEQ ID NO: 2588 - protein, 11 aa, Artificial Sequence
  Description of Artificial Sequence: Synthetic peptide
RASQSISSFLA

SEQ ID NO: 2589 - protein, 7 aa, Artificial Sequence
  Description of Artificial Sequence: Synthetic peptide
DASYRAT

SEQ ID NO: 2590 - protein, 9 aa, Artificial Sequence
  Description of Artificial Sequence: Synthetic peptide
QQRGNWPIT

SEQ ID NO: 2591 - protein, 5 aa, Artificial Sequence
  Description of Artificial Sequence: Synthetic peptide
FYDMY

SEQ ID NO: 2592 - protein, 17 aa, Artificial Sequence
  Description of Artificial Sequence: Synthetic peptide
SIVPSGGATFYADSVKG

SEQ ID NO: 2593 - protein, 15 aa, Artificial Sequence
  Description of Artificial Sequence: Synthetic peptide
DRAYGDYVGWNGFDY

SEQ ID NO: 2594 - protein, 11 aa, Artificial Sequence
  Description of Artificial Sequence: Synthetic peptide
RASQSISSFLA

SEQ ID NO: 2595 - protein, 7 aa, Artificial Sequence
  Description of Artificial Sequence: Synthetic peptide
DASYRAT

SEQ ID NO: 2596 - protein, 9 aa, Artificial Sequence
  Description of Artificial Sequence: Synthetic peptide
QQRGNWPIT

SEQ ID NO: 2597 - protein, 5 aa, Artificial Sequence
  Description of Artificial Sequence: Synthetic peptide
FYEMW

SEQ ID NO: 2598 - protein, 17 aa, Artificial Sequence
  Description of Artificial Sequence: Synthetic peptide
YISPSGGGTYYADSVKG

SEQ ID NO: 2599 - protein, 15 aa, Artificial Sequence
  Description of Artificial Sequence: Synthetic peptide
DRAYGDYVGWNGFDY

SEQ ID NO: 2600 - protein, 11 aa, Artificial Sequence
  Description of Artificial Sequence: Synthetic peptide
RASQSISSFLA

SEQ ID NO: 2601 - protein, 7 aa, Artificial Sequence
  Description of Artificial Sequence: Synthetic peptide
DASYRAT

SEQ ID NO: 2602 - protein, 9 aa, Artificial Sequence
  Description of Artificial Sequence: Synthetic peptide
QQRGNWPIT

SEQ ID NO: 2603 - protein, 5 aa, Artificial Sequence
  Description of Artificial Sequence: Synthetic peptide
FYHMI

SEQ ID NO: 2604 - protein, 16 aa, Artificial Sequence
  Description of Artificial Sequence: Synthetic peptide
YIYSSGGTFYADSVKG

SEQ ID NO: 2605 - protein, 15 aa, Artificial Sequence
  Description of Artificial Sequence: Synthetic peptide
DRAYGDYVGWNGFDY

SEQ ID NO: 2606 - protein, 11 aa, Artificial Sequence
  Description of Artificial Sequence: Synthetic peptide
RASQSISSFLA

SEQ ID NO: 2607 - protein, 7 aa, Artificial Sequence
  Description of Artificial Sequence: Synthetic peptide
DASYRAT

SEQ ID NO: 2608 - protein, 9 aa, Artificial Sequence
  Description of Artificial Sequence: Synthetic peptide
QQRGNWPIT

SEQ ID NO: 2609 - protein, 5 aa, Artificial Sequence
  Description of Artificial Sequence: Synthetic peptide
FYMMW

SEQ ID NO: 2610 - protein, 17 aa, Artificial Sequence
  Description of Artificial Sequence: Synthetic peptide
SISPSGGATFYADSVKG

SEQ ID NO: 2611 - protein, 15 aa, Artificial Sequence
  Description of Artificial Sequence: Synthetic peptide
DRAYGDYVGWNGFDY

SEQ ID NO: 2612 - protein, 11 aa, Artificial Sequence
  Description of Artificial Sequence: Synthetic peptide
RASQSISSFLA

SEQ ID NO: 2613 - protein, 7 aa, Artificial Sequence
  Description of Artificial Sequence: Synthetic peptide
DASYRAT

SEQ ID NO: 2614 - protein, 9 aa, Artificial Sequence
  Description of Artificial Sequence: Synthetic peptide
QQRGNWPIT

SEQ ID NO: 2615 - protein, 5 aa, Artificial Sequence
  Description of Artificial Sequence: Synthetic peptide
FYNMW

SEQ ID NO: 2616 - protein, 17 aa, Artificial Sequence
  Description of Artificial Sequence: Synthetic peptide
SISPSGGGTFYADSVKG

SEQ ID NO: 2617 - protein, 15 aa, Artificial Sequence
  Description of Artificial Sequence: Synthetic peptide
DRAYGDYVGWNGFDY

SEQ ID NO: 2618 - protein, 11 aa, Artificial Sequence
  Description of Artificial Sequence: Synthetic peptide
RASQSISSFLA

SEQ ID NO: 2619 - protein, 7 aa, Artificial Sequence
  Description of Artificial Sequence: Synthetic peptide
DASYRAT

SEQ ID NO: 2620 - protein, 9 aa, Artificial Sequence
  Description of Artificial Sequence: Synthetic peptide
QQRGNWPIT

SEQ ID NO: 2621 - protein, 5 aa, Artificial Sequence
  Description of Artificial Sequence: Synthetic peptide
FYNMW

SEQ ID NO: 2622 - protein, 17 aa, Artificial Sequence
  Description of Artificial Sequence: Synthetic peptide
VIYPSGGKTYYADSVKG

SEQ ID NO: 2623 - protein, 15 aa, Artificial Sequence
  Description of Artificial Sequence: Synthetic peptide
DRAYGDYVGWNGFDY

SEQ ID NO: 2624 - protein, 11 aa, Artificial Sequence
  Description of Artificial Sequence: Synthetic peptide
RASQSISSFLA

SEQ ID NO: 2625 - protein, 7 aa, Artificial Sequence
  Description of Artificial Sequence: Synthetic peptide
DASYRAT

SEQ ID NO: 2626 - protein, 9 aa, Artificial Sequence
  Description of Artificial Sequence: Synthetic peptide
QQRGNWPIT

SEQ ID NO: 2627 - protein, 5 aa, Artificial Sequence
  Description of Artificial Sequence: Synthetic peptide
FYNMW

SEQ ID NO: 2628 - protein, 17 aa, Artificial Sequence
  Description of Artificial Sequence: Synthetic peptide
VIYPSGGPTFYADSVKG

SEQ ID NO: 2629 - protein, 15 aa, Artificial Sequence
  Description of Artificial Sequence: Synthetic peptide
DRAYGDYVGWNGFDY

SEQ ID NO: 2630 - protein, 11 aa, Artificial Sequence
  Description of Artificial Sequence: Synthetic peptide
RASQSISSFLA

SEQ ID NO: 2631 - protein, 7 aa, Artificial Sequence
  Description of Artificial Sequence: Synthetic peptide
DASYRAT

SEQ ID NO: 2632 - protein, 9 aa, Artificial Sequence
  Description of Artificial Sequence: Synthetic peptide
QQRGNWPIT

SEQ ID NO: 2633 - protein, 5 aa, Artificial Sequence
  Description of Artificial Sequence: Synthetic peptide
FYPMI

SEQ ID NO: 2634 - protein, 17 aa, Artificial Sequence
  Description of Artificial Sequence: Synthetic peptide
YISPSGGSTLYADSVKG

SEQ ID NO: 2635 - protein, 15 aa, Artificial Sequence
  Description of Artificial Sequence: Synthetic peptide
DRAYGDYVGWNGFDY

SEQ ID NO: 2636 - protein, 11 aa, Artificial Sequence
  Description of Artificial Sequence: Synthetic peptide
RASQSISSFLA

SEQ ID NO: 2637 - protein, 7 aa, Artificial Sequence
  Description of Artificial Sequence: Synthetic peptide
DASYRAT

SEQ ID NO: 2638 - protein, 9 aa, Artificial Sequence
  Description of Artificial Sequence: Synthetic peptide
QQRGNWPIT

SEQ ID NO: 2639 - protein, 5 aa, Artificial Sequence
  Description of Artificial Sequence: Synthetic peptide
FYPMI

SEQ ID NO: 2640 - protein, 17 aa, Artificial Sequence
  Description of Artificial Sequence: Synthetic peptide
YISSSGGFTDYADSVKG

SEQ ID NO: 2641 - protein, 15 aa, Artificial Sequence
  Description of Artificial Sequence: Synthetic peptide
DRAYGDYVGWNGFDY

SEQ ID NO: 2642 - protein, 11 aa, Artificial Sequence
  Description of Artificial Sequence: Synthetic peptide
RASQSISSFLA

SEQ ID NO: 2643 - protein, 7 aa, Artificial Sequence
  Description of Artificial Sequence: Synthetic peptide
DASYRAT

SEQ ID NO: 2644 - protein, 9 aa, Artificial Sequence
  Description of Artificial Sequence: Synthetic peptide
QQRGNWPIT

SEQ ID NO: 2645 - protein, 5 aa, Artificial Sequence
  Description of Artificial Sequence: Synthetic peptide
FYPMI

SEQ ID NO: 2646 - protein, 17 aa, Artificial Sequence
  Description of Artificial Sequence: Synthetic peptide
YISSSGGYTSYADSVKG

SEQ ID NO: 2647 - protein, 15 aa, Artificial Sequence
  Description of Artificial Sequence: Synthetic peptide
DRAYGDYVGWNGFDY

SEQ ID NO: 2648 - protein, 11 aa, Artificial Sequence
  Description of Artificial Sequence: Synthetic peptide
RASQSISSFLA

SEQ ID NO: 2649 - protein, 7 aa, Artificial Sequence
  Description of Artificial Sequence: Synthetic peptide
DASYRAT

SEQ ID NO: 2650 - protein, 9 aa, Artificial Sequence
  Description of Artificial Sequence: Synthetic peptide
QQRGNWPIT

SEQ ID NO: 2651 - protein, 5 aa, Artificial Sequence
  Description of Artificial Sequence: Synthetic peptide
FYPML

SEQ ID NO: 2652 - protein, 15 aa, Artificial Sequence
  Description of Artificial Sequence: Synthetic peptide
YISGGYTGYADSVKG

SEQ ID NO: 2653 - protein, 15 aa, Artificial Sequence
  Description of Artificial Sequence: Synthetic peptide
DRAYGDYVGWNGFDY

SEQ ID NO: 2654 - protein, 11 aa, Artificial Sequence
  Description of Artificial Sequence: Synthetic peptide
RASQSISSFLA

SEQ ID NO: 2655 - protein, 7 aa, Artificial Sequence
  Description of Artificial Sequence: Synthetic peptide
DASYRAT

SEQ ID NO: 2656 - protein, 9 aa, Artificial Sequence
  Description of Artificial Sequence: Synthetic peptide
QQRGNWPIT

SEQ ID NO: 2657 - protein, 5 aa, Artificial Sequence
  Description of Artificial Sequence: Synthetic peptide
FYPMM

SEQ ID NO: 2658 - protein, 17 aa, Artificial Sequence
  Description of Artificial Sequence: Synthetic peptide
YISFSGGYTGYADSVKG

SEQ ID NO: 2659 - protein, 15 aa, Artificial Sequence
  Description of Artificial Sequence: Synthetic peptide
DRAYGDYVGWNGFDY

SEQ ID NO: 2660 - protein, 11 aa, Artificial Sequence
  Description of Artificial Sequence: Synthetic peptide
RASQSISSFLA

SEQ ID NO: 2661 - protein, 7 aa, Artificial Sequence
  Description of Artificial Sequence: Synthetic peptide
DASYRAT

SEQ ID NO: 2662 - protein, 9 aa, Artificial Sequence
  Description of Artificial Sequence: Synthetic peptide
QQRGNWPIT

SEQ ID NO: 2663 - protein, 5 aa, Artificial Sequence
  Description of Artificial Sequence: Synthetic peptide
FYPMW

SEQ ID NO: 2664 - protein, 17 aa, Artificial Sequence
  Description of Artificial Sequence: Synthetic peptide
YIYPSGGATFYADSVKG

SEQ ID NO: 2665 - protein, 15 aa, Artificial Sequence
  Description of Artificial Sequence: Synthetic peptide
DRAYGDYVGWNGFDY

SEQ ID NO: 2666 - protein, 11 aa, Artificial Sequence
  Description of Artificial Sequence: Synthetic peptide
RASQSISSFLA

SEQ ID NO: 2667 - protein, 7 aa, Artificial Sequence
  Description of Artificial Sequence: Synthetic peptide
DASYRAT

SEQ ID NO: 2668 - protein, 9 aa, Artificial Sequence
  Description of Artificial Sequence: Synthetic peptide
QQRGNWPIT

SEQ ID NO: 2669 - protein, 5 aa, Artificial Sequence
  Description of Artificial Sequence: Synthetic peptide
GYDMW

SEQ ID NO: 2670 - protein, 17 aa, Artificial Sequence
  Description of Artificial Sequence: Synthetic peptide
VISPSGGGTFYADSVKG

SEQ ID NO: 2671 - protein, 15 aa, Artificial Sequence
  Description of Artificial Sequence: Synthetic peptide
DRAYGDYVGWNGFDY

SEQ ID NO: 2672 - protein, 11 aa, Artificial Sequence
  Description of Artificial Sequence: Synthetic peptide
RASQSISSFLA

SEQ ID NO: 2673 - protein, 7 aa, Artificial Sequence
  Description of Artificial Sequence: Synthetic peptide
DASYRAT

SEQ ID NO: 2674 - protein, 9 aa, Artificial Sequence
  Description of Artificial Sequence: Synthetic peptide
QQRGNWPIT

SEQ ID NO: 2675 - protein, 5 aa, Artificial Sequence
  Description of Artificial Sequence: Synthetic peptide
GYDMW

SEQ ID NO: 2676 - protein, 17 aa, Artificial Sequence
  Description of Artificial Sequence: Synthetic peptide
VIYSSGGTTFYADSVKG

SEQ ID NO: 2677 - protein, 15 aa, Artificial Sequence
  Description of Artificial Sequence: Synthetic peptide
DRAYGDYVGWNGFDY

SEQ ID NO: 2678 - protein, 11 aa, Artificial Sequence
  Description of Artificial Sequence: Synthetic peptide
RASQSISSFLA

SEQ ID NO: 2679 - protein, 7 aa, Artificial Sequence
  Description of Artificial Sequence: Synthetic peptide
DASYRAT

SEQ ID NO: 2680 - protein, 9 aa, Artificial Sequence
  Description of Artificial Sequence: Synthetic peptide
QQRGNWPIT

SEQ ID NO: 2681 - protein, 5 aa, Artificial Sequence
  Description of Artificial Sequence: Synthetic peptide
GYNMW

SEQ ID NO: 2682 - protein, 17 aa, Artificial Sequence
  Description of Artificial Sequence: Synthetic peptide
VIYPSGGATFYADSVKG

SEQ ID NO: 2683 - protein, 15 aa, Artificial Sequence
  Description of Artificial Sequence: Synthetic peptide
DRAYGDYVGWNGFDY

SEQ ID NO: 2684 - protein, 11 aa, Artificial Sequence
  Description of Artificial Sequence: Synthetic peptide
RASQSISSFLA

SEQ ID NO: 2685 - protein, 7 aa, Artificial Sequence
  Description of Artificial Sequence: Synthetic peptide
DASYRAT

SEQ ID NO: 2686 - protein, 9 aa, Artificial Sequence
  Description of Artificial Sequence: Synthetic peptide
QQRGNWPIT

SEQ ID NO: 2687 - protein, 5 aa, Artificial Sequence
  Description of Artificial Sequence: Synthetic peptide
GYPMW

SEQ ID NO: 2688 - protein, 17 aa, Artificial Sequence
  Description of Artificial Sequence: Synthetic peptide
YISSSGGGTFYADSVKG

SEQ ID NO: 2689 - protein, 15 aa, Artificial Sequence
  Description of Artificial Sequence: Synthetic peptide
DRAYGDYVGWNGFDY

SEQ ID NO: 2690 - protein, 11 aa, Artificial Sequence
  Description of Artificial Sequence: Synthetic peptide
RASQSISSFLA

SEQ ID NO: 2691 - protein, 7 aa, Artificial Sequence
  Description of Artificial Sequence: Synthetic peptide
DASYRAT

SEQ ID NO: 2692 - protein, 9 aa, Artificial Sequence
  Description of Artificial Sequence: Synthetic peptide
QQRGNWPIT

SEQ ID NO: 2693 - protein, 5 aa, Artificial Sequence
  Description of Artificial Sequence: Synthetic peptide
HYAMI

SEQ ID NO: 2694 - protein, 17 aa, Artificial Sequence
  Description of Artificial Sequence: Synthetic peptide
YIVPSGGWTDYADSVKG

SEQ ID NO: 2695 - protein, 15 aa, Artificial Sequence
  Description of Artificial Sequence: Synthetic peptide
DRAYGDYVGWNGFDY

SEQ ID NO: 2696 - protein, 11 aa, Artificial Sequence
  Description of Artificial Sequence: Synthetic peptide
RASQSISSFLA

SEQ ID NO: 2697 - protein, 7 aa, Artificial Sequence
  Description of Artificial Sequence: Synthetic peptide
DASYRAT

SEQ ID NO: 2698 - protein, 9 aa, Artificial Sequence
  Description of Artificial Sequence: Synthetic peptide
QQRGNWPIT

SEQ ID NO: 2699 - protein, 5 aa, Artificial Sequence
  Description of Artificial Sequence: Synthetic peptide
HYAMI

SEQ ID NO: 2700 - protein, 17 aa, Artificial Sequence
  Description of Artificial Sequence: Synthetic peptide
YIVPSGGWTGYADSVKG

SEQ ID NO: 2701 - protein, 15 aa, Artificial Sequence
  Description of Artificial Sequence: Synthetic peptide
DRAYGDYVGWNGFDY

SEQ ID NO: 2702 - protein, 11 aa, Artificial Sequence
  Description of Artificial Sequence: Synthetic peptide
RASQSISSFLA

SEQ ID NO: 2703 - protein, 7 aa, Artificial Sequence
  Description of Artificial Sequence: Synthetic peptide
DASYRAT

SEQ ID NO: 2704 - protein, 9 aa, Artificial Sequence
  Description of Artificial Sequence: Synthetic peptide
QQRGNWPIT

SEQ ID NO: 2705 - protein, 5 aa, Artificial Sequence
  Description of Artificial Sequence: Synthetic peptide
HYDMW

SEQ ID NO: 2706 - protein, 17 aa, Artificial Sequence
  Description of Artificial Sequence: Synthetic peptide
SISPSGGATFYADSVKG

SEQ ID NO: 2707 - protein, 15 aa, Artificial Sequence
  Description of Artificial Sequence: Synthetic peptide
DRAYGDYVGWNGFDY

SEQ ID NO: 2708 - protein, 11 aa, Artificial Sequence
  Description of Artificial Sequence: Synthetic peptide
RASQSISSFLA

SEQ ID NO: 2709 - protein, 7 aa, Artificial Sequence
  Description of Artificial Sequence: Synthetic peptide
DASYRAT

SEQ ID NO: 2710 - protein, 9 aa, Artificial Sequence
  Description of Artificial Sequence: Synthetic peptide
QQRGNWPIT

SEQ ID NO: 2711 - protein, 5 aa, Artificial Sequence
  Description of Artificial Sequence: Synthetic peptide
HYDMW

SEQ ID NO: 2712 - protein, 16 aa, Artificial Sequence
  Description of Artificial Sequence: Synthetic peptide
VIVSSGKTFYADSVKG

SEQ ID NO: 2713 - protein, 15 aa, Artificial Sequence
  Description of Artificial Sequence: Synthetic peptide
DRAYGDYVGWNGFDY

SEQ ID NO: 2714 - protein, 11 aa, Artificial Sequence
  Description of Artificial Sequence: Synthetic peptide
RASQSISSFLA

SEQ ID NO: 2715 - protein, 7 aa, Artificial Sequence
  Description of Artificial Sequence: Synthetic peptide
DASYRAT

SEQ ID NO: 2716 - protein, 9 aa, Artificial Sequence
  Description of Artificial Sequence: Synthetic peptide
QQRGNWPIT

SEQ ID NO: 2717 - protein, 5 aa, Artificial Sequence
  Description of Artificial Sequence: Synthetic peptide
HYDMW

SEQ ID NO: 2718 - protein, 17 aa, Artificial Sequence
  Description of Artificial Sequence: Synthetic peptide
VIYPSGGFTDYADSVKG

SEQ ID NO: 2719 - protein, 15 aa, Artificial Sequence
  Description of Artificial Sequence: Synthetic peptide
DRAYGDYVGWNGFDY

SEQ ID NO: 2720 - protein, 11 aa, Artificial Sequence
  Description of Artificial Sequence: Synthetic peptide
RASQSISSFLA

SEQ ID NO: 2721 - protein, 7 aa, Artificial Sequence
  Description of Artificial Sequence: Synthetic peptide
DASYRAT

SEQ ID NO: 2722 - protein, 9 aa, Artificial Sequence
  Description of Artificial Sequence: Synthetic peptide
QQRGNWPIT

SEQ ID NO: 2723 - protein, 5 aa, Artificial Sequence
  Description of Artificial Sequence: Synthetic peptide
HYDMW

SEQ ID NO: 2724 - protein, 17 aa, Artificial Sequence
  Description of Artificial Sequence: Synthetic peptide
VIYPSGGHTLYADSVKG

SEQ ID NO: 2725 - protein, 15 aa, Artificial Sequence
  Description of Artificial Sequence: Synthetic peptide
DRAYGDYVGWNGFDY

SEQ ID NO: 2726 - protein, 11 aa, Artificial Sequence
  Description of Artificial Sequence: Synthetic peptide
RASQSISSFLA

SEQ ID NO: 2727 - protein, 7 aa, Artificial Sequence
  Description of Artificial Sequence: Synthetic peptide
DASYRAT

SEQ ID NO: 2728 - protein, 9 aa, Artificial Sequence
  Description of Artificial Sequence: Synthetic peptide
QQRGNWPIT

SEQ ID NO: 2729 - protein, 5 aa, Artificial Sequence
  Description of Artificial Sequence: Synthetic peptide
HYDMW

SEQ ID NO: 2730 - protein, 17 aa, Artificial Sequence
  Description of Artificial Sequence: Synthetic peptide
VIYPSGGPTYYADSVKG

SEQ ID NO: 2731 - protein, 15 aa, Artificial Sequence
  Description of Artificial Sequence: Synthetic peptide
DRAYGDYVGWNGFDY

SEQ ID NO: 2732 - protein, 11 aa, Artificial Sequence
  Description of Artificial Sequence: Synthetic peptide
RASQSISSFLA

SEQ ID NO: 2733 - protein, 7 aa, Artificial Sequence
  Description of Artificial Sequence: Synthetic peptide
DASYRAT

SEQ ID NO: 2734 - protein, 9 aa, Artificial Sequence
  Description of Artificial Sequence: Synthetic peptide
QQRGNWPIT

SEQ ID NO: 2735 - protein, 5 aa, Artificial Sequence
  Description of Artificial Sequence: Synthetic peptide
HYDMW

SEQ ID NO: 2736 - protein, 17 aa, Artificial Sequence
  Description of Artificial Sequence: Synthetic peptide
VIYPSGGVTYYADSVKG

SEQ ID NO: 2737 - protein, 15 aa, Artificial Sequence
  Description of Artificial Sequence: Synthetic peptide
DRAYGDYVGWNGFDY

SEQ ID NO: 2738 - protein, 11 aa, Artificial Sequence
  Description of Artificial Sequence: Synthetic peptide
RASQSISSFLA

SEQ ID NO: 2739 - protein, 7 aa, Artificial Sequence
  Description of Artificial Sequence: Synthetic peptide
DASYRAT

SEQ ID NO: 2740 - protein, 9 aa, Artificial Sequence
  Description of Artificial Sequence: Synthetic peptide
QQRGNWPIT

SEQ ID NO: 2741 - protein, 5 aa, Artificial Sequence
  Description of Artificial Sequence: Synthetic peptide
HYDMW

SEQ ID NO: 2742 - protein, 17 aa, Artificial Sequence
  Description of Artificial Sequence: Synthetic peptide
VIYSSGGFTGYADSVKG

SEQ ID NO: 2743 - protein, 15 aa, Artificial Sequence
  Description of Artificial Sequence: Synthetic peptide
DRAYGDYVGWNGFDY

SEQ ID NO: 2744 - protein, 11 aa, Artificial Sequence
  Description of Artificial Sequence: Synthetic peptide
RASQSISSFLA

SEQ ID NO: 2745 - protein, 7 aa, Artificial Sequence
  Description of Artificial Sequence: Synthetic peptide
DASYRAT

SEQ ID NO: 2746 - protein, 9 aa, Artificial Sequence
  Description of Artificial Sequence: Synthetic peptide
QQRGNWPIT

SEQ ID NO: 2747 - protein, 5 aa, Artificial Sequence
  Description of Artificial Sequence: Synthetic peptide
HYDMW

SEQ ID NO: 2748 - protein, 17 aa, Artificial Sequence
  Description of Artificial Sequence: Synthetic peptide
VIYSSGGPTYYADSVKG

SEQ ID NO: 2749 - protein, 15 aa, Artificial Sequence
  Description of Artificial Sequence: Synthetic peptide
DRAYGDYVGWNGFDY

SEQ ID NO: 2750 - protein, 11 aa, Artificial Sequence
  Description of Artificial Sequence: Synthetic peptide
RASQSISSFLA

SEQ ID NO: 2751 - protein, 7 aa, Artificial Sequence
  Description of Artificial Sequence: Synthetic peptide
DASYRAT

SEQ ID NO: 2752 - protein, 9 aa, Artificial Sequence
  Description of Artificial Sequence: Synthetic peptide
QQRGNWPIT

SEQ ID NO: 2753 - protein, 5 aa, Artificial Sequence
  Description of Artificial Sequence: Synthetic peptide
HYDMW

SEQ ID NO: 2754 - protein, 17 aa, Artificial Sequence
  Description of Artificial Sequence: Synthetic peptide
YISPSGGFTSYADSVKG

SEQ ID NO: 2755 - protein, 15 aa, Artificial Sequence
  Description of Artificial Sequence: Synthetic peptide
DRAYGDYVGWNGFDY

SEQ ID NO: 2756 - protein, 11 aa, Artificial Sequence
  Description of Artificial Sequence: Synthetic peptide
RASQSISSFLA

SEQ ID NO: 2757 - protein, 7 aa, Artificial Sequence
  Description of Artificial Sequence: Synthetic peptide
DASYRAT

SEQ ID NO: 2758 - protein, 9 aa, Artificial Sequence
  Description of Artificial Sequence: Synthetic peptide
QQRGNWPIT

SEQ ID NO: 2759 - protein, 5 aa, Artificial Sequence
  Description of Artificial Sequence: Synthetic peptide
HYEMW

SEQ ID NO: 2760 - protein, 17 aa, Artificial Sequence
  Description of Artificial Sequence: Synthetic peptide
SISSSGGGTFYADSVKG

SEQ ID NO: 2761 - protein, 15 aa, Artificial Sequence
  Description of Artificial Sequence: Synthetic peptide
DRAYGDYVGWNGFDY

SEQ ID NO: 2762 - protein, 11 aa, Artificial Sequence
  Description of Artificial Sequence: Synthetic peptide
RASQSISSFLA

SEQ ID NO: 2763 - protein, 7 aa, Artificial Sequence
  Description of Artificial Sequence: Synthetic peptide
DASYRAT

SEQ ID NO: 2764 - protein, 9 aa, Artificial Sequence
  Description of Artificial Sequence: Synthetic peptide
QQRGNWPIT

SEQ ID NO: 2765 - protein, 5 aa, Artificial Sequence
  Description of Artificial Sequence: Synthetic peptide
HYEMW

SEQ ID NO: 2766 - protein, 17 aa, Artificial Sequence
  Description of Artificial Sequence: Synthetic peptide
YIGSSGGSTYYADSVKG

SEQ ID NO: 2767 - protein, 15 aa, Artificial Sequence
  Description of Artificial Sequence: Synthetic peptide
DRAYGDYVGWNGFDY

SEQ ID NO: 2768 - protein, 11 aa, Artificial Sequence
  Description of Artificial Sequence: Synthetic peptide
RASQSISSFLA

SEQ ID NO: 2769 - protein, 7 aa, Artificial Sequence
  Description of Artificial Sequence: Synthetic peptide
DASYRAT

SEQ ID NO: 2770 - protein, 9 aa, Artificial Sequence
  Description of Artificial Sequence: Synthetic peptide
QQRGNWPIT

SEQ ID NO: 2771 - protein, 5 aa, Artificial Sequence
  Description of Artificial Sequence: Synthetic peptide
HYMMI

SEQ ID NO: 2772 - protein, 17 aa, Artificial Sequence
  Description of Artificial Sequence: Synthetic peptide
GISPSGGYTGYADSVKG

SEQ ID NO: 2773 - protein, 15 aa, Artificial Sequence
  Description of Artificial Sequence: Synthetic peptide
DRAYGDYVGWNGFDY

SEQ ID NO: 2774 - protein, 11 aa, Artificial Sequence
  Description of Artificial Sequence: Synthetic peptide
RASQSISSFLA

SEQ ID NO: 2775 - protein, 7 aa, Artificial Sequence
  Description of Artificial Sequence: Synthetic peptide
DASYRAT

SEQ ID NO: 2776 - protein, 9 aa, Artificial Sequence
  Description of Artificial Sequence: Synthetic peptide
QQRGNWPIT

SEQ ID NO: 2777 - protein, 5 aa, Artificial Sequence
  Description of Artificial Sequence: Synthetic peptide
HYMMW

SEQ ID NO: 2778 - protein, 17 aa, Artificial Sequence
  Description of Artificial Sequence: Synthetic peptide
SIYPSGGGTYYADSVKG

SEQ ID NO: 2779 - protein, 15 aa, Artificial Sequence
  Description of Artificial Sequence: Synthetic peptide
DRAYGDYVGWNGFDY

SEQ ID NO: 2780 - protein, 11 aa, Artificial Sequence
  Description of Artificial Sequence: Synthetic peptide
RASQSISSFLA

SEQ ID NO: 2781 - protein, 7 aa, Artificial Sequence
  Description of Artificial Sequence: Synthetic peptide
DASYRAT

SEQ ID NO: 2782 - protein, 9 aa, Artificial Sequence
  Description of Artificial Sequence: Synthetic peptide
QQRGNWPIT

SEQ ID NO: 2783 - protein, 5 aa, Artificial Sequence
  Description of Artificial Sequence: Synthetic peptide
HYMMW

SEQ ID NO: 2784 - protein, 16 aa, Artificial Sequence
  Description of Artificial Sequence: Synthetic peptide
SIYPSGGTYYADSVKG

SEQ ID NO: 2785 - protein, 15 aa, Artificial Sequence
  Description of Artificial Sequence: Synthetic peptide
DRAYGDYVGWNGFDY

SEQ ID NO: 2786 - protein, 11 aa, Artificial Sequence
  Description of Artificial Sequence: Synthetic peptide
RASQSISSFLA

SEQ ID NO: 2787 - protein, 7 aa, Artificial Sequence
  Description of Artificial Sequence: Synthetic peptide
DASYRAT

SEQ ID NO: 2788 - protein, 9 aa, Artificial Sequence
  Description of Artificial Sequence: Synthetic peptide
QQRGNWPIT

SEQ ID NO: 2789 - protein, 5 aa, Artificial Sequence
  Description of Artificial Sequence: Synthetic peptide
HYPMF

SEQ ID NO: 2790 - protein, 17 aa, Artificial Sequence
  Description of Artificial Sequence: Synthetic peptide
YISSSGGWTDYADSVKG

SEQ ID NO: 2791 - protein, 15 aa, Artificial Sequence
  Description of Artificial Sequence: Synthetic peptide
DRAYGDYVGWNGFDY

SEQ ID NO: 2792 - protein, 11 aa, Artificial Sequence
  Description of Artificial Sequence: Synthetic peptide
RASQSISSFLA

SEQ ID NO: 2793 - protein, 7 aa, Artificial Sequence
  Description of Artificial Sequence: Synthetic peptide
DASYRAT

SEQ ID NO: 2794 - protein, 9 aa, Artificial Sequence
  Description of Artificial Sequence: Synthetic peptide
QQRGNWPIT

SEQ ID NO: 2795 - protein, 5 aa, Artificial Sequence
  Description of Artificial Sequence: Synthetic peptide
HYPMI

SEQ ID NO: 2796 - protein, 17 aa, Artificial Sequence
  Description of Artificial Sequence: Synthetic peptide
YISPSGGGTFYADSVKG

SEQ ID NO: 2797 - protein, 15 aa, Artificial Sequence
  Description of Artificial Sequence: Synthetic peptide
DRAYGDYVGWNGFDY

SEQ ID NO: 2798 - protein, 11 aa, Artificial Sequence
  Description of Artificial Sequence: Synthetic peptide
RASQSISSFLA

SEQ ID NO: 2799 - protein, 7 aa, Artificial Sequence
  Description of Artificial Sequence: Synthetic peptide
DASYRAT

SEQ ID NO: 2800 - protein, 9 aa, Artificial Sequence
  Description of Artificial Sequence: Synthetic peptide
QQRGNWPIT

SEQ ID NO: 2801 - protein, 5 aa, Artificial Sequence
  Description of Artificial Sequence: Synthetic peptide
HYPMI

SEQ ID NO: 2802 - protein, 17 aa, Artificial Sequence
  Description of Artificial Sequence: Synthetic peptide
YISSSGGGTFYADSVKG

SEQ ID NO: 2803 - protein, 15 aa, Artificial Sequence
  Description of Artificial Sequence: Synthetic peptide
DRAYGDYVGWNGFDY

SEQ ID NO: 2804 - protein, 11 aa, Artificial Sequence
  Description of Artificial Sequence: Synthetic peptide
RASQSISSFLA

SEQ ID NO: 2805 - protein, 7 aa, Artificial Sequence
  Description of Artificial Sequence: Synthetic peptide
DASYRAT

SEQ ID NO: 2806 - protein, 9 aa, Artificial Sequence
  Description of Artificial Sequence: Synthetic peptide
QQRGNWPIT

SEQ ID NO: 2807 - protein, 5 aa, Artificial Sequence
  Description of Artificial Sequence: Synthetic peptide
HYPMI

SEQ ID NO: 2808 - protein, 17 aa, Artificial Sequence
  Description of Artificial Sequence: Synthetic peptide
YIYSSGGGTFYADSVKG

SEQ ID NO: 2809 - protein, 15 aa, Artificial Sequence
  Description of Artificial Sequence: Synthetic peptide
DRAYGDYVGWNGFDY

SEQ ID NO: 2810 - protein, 11 aa, Artificial Sequence
  Description of Artificial Sequence: Synthetic peptide
RASQSISSFLA

SEQ ID NO: 2811 - protein, 7 aa, Artificial Sequence
  Description of Artificial Sequence: Synthetic peptide
DASYRAT

SEQ ID NO: 2812 - protein, 9 aa, Artificial Sequence
  Description of Artificial Sequence: Synthetic peptide
QQRGNWPIT

SEQ ID NO: 2813 - protein, 5 aa, Artificial Sequence
  Description of Artificial Sequence: Synthetic peptide
HYPML

SEQ ID NO: 2814 - protein, 17 aa, Artificial Sequence
  Description of Artificial Sequence: Synthetic peptide
YIYPSGGGTFYADSVKG

SEQ ID NO: 2815 - protein, 15 aa, Artificial Sequence
  Description of Artificial Sequence: Synthetic peptide
DRAYGDYVGWNGFDY

SEQ ID NO: 2816 - protein, 11 aa, Artificial Sequence
  Description of Artificial Sequence: Synthetic peptide
RASQSISSFLA

SEQ ID NO: 2817 - protein, 7 aa, Artificial Sequence
  Description of Artificial Sequence: Synthetic peptide
DASYRAT

SEQ ID NO: 2818 - protein, 9 aa, Artificial Sequence
  Description of Artificial Sequence: Synthetic peptide
QQRGNWPIT

SEQ ID NO: 2819 - protein, 5 aa, Artificial Sequence
  Description of Artificial Sequence: Synthetic peptide
HYPMM

SEQ ID NO: 2820 - protein, 17 aa, Artificial Sequence
  Description of Artificial Sequence: Synthetic peptide
YISSSGGYTGYADSVKG

SEQ ID NO: 2821 - protein, 15 aa, Artificial Sequence
  Description of Artificial Sequence: Synthetic peptide
DRAYGDYVGWNGFDY

SEQ ID NO: 2822 - protein, 11 aa, Artificial Sequence
  Description of Artificial Sequence: Synthetic peptide
RASQSISSFLA

SEQ ID NO: 2823 - protein, 7 aa, Artificial Sequence
  Description of Artificial Sequence: Synthetic peptide
DASYRAT

SEQ ID NO: 2824 - protein, 9 aa, Artificial Sequence
  Description of Artificial Sequence: Synthetic peptide
QQRGNWPIT

SEQ ID NO: 2825 - protein, 5 aa, Artificial Sequence
  Description of Artificial Sequence: Synthetic peptide
HYPMM

SEQ ID NO: 2826 - protein, 17 aa, Artificial Sequence
  Description of Artificial Sequence: Synthetic peptide
YIYSSGGGTYYADSVKG

SEQ ID NO: 2827 - protein, 15 aa, Artificial Sequence
  Description of Artificial Sequence: Synthetic peptide
DRAYGDYVGWNGFDY

SEQ ID NO: 2828 - protein, 11 aa, Artificial Sequence
  Description of Artificial Sequence: Synthetic peptide
RASQSISSFLA

SEQ ID NO: 2829 - protein, 7 aa, Artificial Sequence
  Description of Artificial Sequence: Synthetic peptide
DASYRAT

SEQ ID NO: 2830 - protein, 9 aa, Artificial Sequence
  Description of Artificial Sequence: Synthetic peptide
QQRGNWPIT

SEQ ID NO: 2831 - protein, 5 aa, Artificial Sequence
  Description of Artificial Sequence: Synthetic peptide
HYPMV

SEQ ID NO: 2832 - protein, 17 aa, Artificial Sequence
  Description of Artificial Sequence: Synthetic peptide
YISPSGGYTGYADSVKG

SEQ ID NO: 2833 - protein, 15 aa, Artificial Sequence
  Description of Artificial Sequence: Synthetic peptide
DRAYGDYVGWNGFDY

SEQ ID NO: 2834 - protein, 11 aa, Artificial Sequence
  Description of Artificial Sequence: Synthetic peptide
RASQSISSFLA

SEQ ID NO: 2835 - protein, 7 aa, Artificial Sequence
  Description of Artificial Sequence: Synthetic peptide
DASYRAT

SEQ ID NO: 2836 - protein, 9 aa, Artificial Sequence
  Description of Artificial Sequence: Synthetic peptide
QQRGNWPIT

SEQ ID NO: 2837 - protein, 5 aa, Artificial Sequence
  Description of Artificial Sequence: Synthetic peptide
HYPMW

SEQ ID NO: 2838 - protein, 17 aa, Artificial Sequence
  Description of Artificial Sequence: Synthetic peptide
SISPSGGATFYADSVKG

SEQ ID NO: 2839 - protein, 15 aa, Artificial Sequence
  Description of Artificial Sequence: Synthetic peptide
DRAYGDYVGWNGFDY

SEQ ID NO: 2840 - protein, 11 aa, Artificial Sequence
  Description of Artificial Sequence: Synthetic peptide
RASQSISSFLA

SEQ ID NO: 2841 - protein, 7 aa, Artificial Sequence
  Description of Artificial Sequence: Synthetic peptide
DASYRAT

SEQ ID NO: 2842 - protein, 9 aa, Artificial Sequence
  Description of Artificial Sequence: Synthetic peptide
QQRGNWPIT

SEQ ID NO: 2843 - protein, 5 aa, Artificial Sequence
  Description of Artificial Sequence: Synthetic peptide
HYPMW

SEQ ID NO: 2844 - protein, 17 aa, Artificial Sequence
  Description of Artificial Sequence: Synthetic peptide
VIYSSGGGTFYADSVKG

SEQ ID NO: 2845 - protein, 15 aa, Artificial Sequence
  Description of Artificial Sequence: Synthetic peptide
DRAYGDYVGWNGFDY

SEQ ID NO: 2846 - protein, 11 aa, Artificial Sequence
  Description of Artificial Sequence: Synthetic peptide
RASQSISSFLA

SEQ ID NO: 2847 - protein, 7 aa, Artificial Sequence
  Description of Artificial Sequence: Synthetic peptide
DASYRAT

SEQ ID NO: 2848 - protein, 9 aa, Artificial Sequence
  Description of Artificial Sequence: Synthetic peptide
QQRGNWPIT

SEQ ID NO: 2849 - protein, 5 aa, Artificial Sequence
  Description of Artificial Sequence: Synthetic peptide
HYPMW

SEQ ID NO: 2850 - protein, 17 aa, Artificial Sequence
  Description of Artificial Sequence: Synthetic peptide
WIVPSGGFTLYADSVKG

SEQ ID NO: 2851 - protein, 15 aa, Artificial Sequence
  Description of Artificial Sequence: Synthetic peptide
DRAYGDYVGWNGFDY

SEQ ID NO: 2852 - protein, 11 aa, Artificial Sequence
  Description of Artificial Sequence: Synthetic peptide
RASQSISSFLA

SEQ ID NO: 2853 - protein, 7 aa, Artificial Sequence
  Description of Artificial Sequence: Synthetic peptide
DASYRAT

SEQ ID NO: 2854 - protein, 9 aa, Artificial Sequence
  Description of Artificial Sequence: Synthetic peptide
QQRGNWPIT

SEQ ID NO: 2855 - protein, 5 aa, Artificial Sequence
  Description of Artificial Sequence: Synthetic peptide
HYPMW

SEQ ID NO: 2856 - protein, 17 aa, Artificial Sequence
  Description of Artificial Sequence: Synthetic peptide
YIHPSGGGTLYADSVKG

SEQ ID NO: 2857 - protein, 15 aa, Artificial Sequence
  Description of Artificial Sequence: Synthetic peptide
DRAYGDYVGWNGFDY

SEQ ID NO: 2858 - protein, 11 aa, Artificial Sequence
  Description of Artificial Sequence: Synthetic peptide
RASQSISSFLA

SEQ ID NO: 2859 - protein, 7 aa, Artificial Sequence
  Description of Artificial Sequence: Synthetic peptide
DASYRAT

SEQ ID NO: 2860 - protein, 9 aa, Artificial Sequence
  Description of Artificial Sequence: Synthetic peptide
QQRGNWPIT

SEQ ID NO: 2861 - protein, 5 aa, Artificial Sequence
  Description of Artificial Sequence: Synthetic peptide
HYPMW

SEQ ID NO: 2862 - protein, 17 aa, Artificial Sequence
  Description of Artificial Sequence: Synthetic peptide
YISSSGGGTFYADSVKG

SEQ ID NO: 2863 - protein, 15 aa, Artificial Sequence
  Description of Artificial Sequence: Synthetic peptide
DRAYGDYVGWNGFDY

SEQ ID NO: 2864 - protein, 11 aa, Artificial Sequence
  Description of Artificial Sequence: Synthetic peptide
RASQSISSFLA

SEQ ID NO: 2865 - protein, 7 aa, Artificial Sequence
  Description of Artificial Sequence: Synthetic peptide
DASYRAT

SEQ ID NO: 2866 - protein, 9 aa, Artificial Sequence
  Description of Artificial Sequence: Synthetic peptide
QQRGNWPIT

SEQ ID NO: 2867 - protein, 5 aa, Artificial Sequence
  Description of Artificial Sequence: Synthetic peptide
HYPMW

SEQ ID NO: 2868 - protein, 17 aa, Artificial Sequence
  Description of Artificial Sequence: Synthetic peptide
YIVPSGGATFYADSVKG

SEQ ID NO: 2869 - protein, 15 aa, Artificial Sequence
  Description of Artificial Sequence: Synthetic peptide
DRAYGDYVGWNGFDY

SEQ ID NO: 2870 - protein, 11 aa, Artificial Sequence
  Description of Artificial Sequence: Synthetic peptide
RASQSISSFLA

SEQ ID NO: 2871 - protein, 7 aa, Artificial Sequence
  Description of Artificial Sequence: Synthetic peptide
DASYRAT

SEQ ID NO: 2872 - protein, 9 aa, Artificial Sequence
  Description of Artificial Sequence: Synthetic peptide
QQRGNWPIT

SEQ ID NO: 2873 - protein, 5 aa, Artificial Sequence
  Description of Artificial Sequence: Synthetic peptide
HYPMW

SEQ ID NO: 2874 - protein, 17 aa, Artificial Sequence
  Description of Artificial Sequence: Synthetic peptide
YIYPSGGGTYYADSVKG

SEQ ID NO: 2875 - protein, 15 aa, Artificial Sequence
  Description of Artificial Sequence: Synthetic peptide
DRAYGDYVGWNGFDY

SEQ ID NO: 2876 - protein, 11 aa, Artificial Sequence
  Description of Artificial Sequence: Synthetic peptide
RASQSISSFLA

SEQ ID NO: 2877 - protein, 7 aa, Artificial Sequence
  Description of Artificial Sequence: Synthetic peptide
DASYRAT

SEQ ID NO: 2878 - protein, 9 aa, Artificial Sequence
  Description of Artificial Sequence: Synthetic peptide
QQRGNWPIT

SEQ ID NO: 2879 - protein, 5 aa, Artificial Sequence
  Description of Artificial Sequence: Synthetic peptide
HYQMW

SEQ ID NO: 2880 - protein, 17 aa, Artificial Sequence
  Description of Artificial Sequence: Synthetic peptide
SISSSGGGTYYADSVKG

SEQ ID NO: 2881 - protein, 15 aa, Artificial Sequence
  Description of Artificial Sequence: Synthetic peptide
DRAYGDYVGWNGFDY

SEQ ID NO: 2882 - protein, 11 aa, Artificial Sequence
  Description of Artificial Sequence: Synthetic peptide
RASQSISSFLA

SEQ ID NO: 2883 - protein, 7 aa, Artificial Sequence
  Description of Artificial Sequence: Synthetic peptide
DASYRAT

SEQ ID NO: 2884 - protein, 9 aa, Artificial Sequence
  Description of Artificial Sequence: Synthetic peptide
QQRGNWPIT

SEQ ID NO: 2885 - protein, 5 aa, Artificial Sequence
  Description of Artificial Sequence: Synthetic peptide
HYSMM

SEQ ID NO: 2886 - protein, 17 aa, Artificial Sequence
  Description of Artificial Sequence: Synthetic peptide
YISPSGGYTGYADSVKG

SEQ ID NO: 2887 - protein, 15 aa, Artificial Sequence
  Description of Artificial Sequence: Synthetic peptide
DRAYGDYVGWNGFDY

SEQ ID NO: 2888 - protein, 11 aa, Artificial Sequence
  Description of Artificial Sequence: Synthetic peptide
RASQSISSFLA

SEQ ID NO: 2889 - protein, 7 aa, Artificial Sequence
  Description of Artificial Sequence: Synthetic peptide
DASYRAT

SEQ ID NO: 2890 - protein, 9 aa, Artificial Sequence
  Description of Artificial Sequence: Synthetic peptide
QQRGNWPIT

SEQ ID NO: 2891 - protein, 5 aa, Artificial Sequence
  Description of Artificial Sequence: Synthetic peptide
HYSMW

SEQ ID NO: 2892 - protein, 17 aa, Artificial Sequence
  Description of Artificial Sequence: Synthetic peptide
VIYPSGGATFYADSVKG

SEQ ID NO: 2893 - protein, 15 aa, Artificial Sequence
  Description of Artificial Sequence: Synthetic peptide
DRAYGDYVGWNGFDY

SEQ ID NO: 2894 - protein, 11 aa, Artificial Sequence
  Description of Artificial Sequence: Synthetic peptide
RASQSISSFLA

SEQ ID NO: 2895 - protein, 7 aa, Artificial Sequence
  Description of Artificial Sequence: Synthetic peptide
DASYRAT

SEQ ID NO: 2896 - protein, 9 aa, Artificial Sequence
  Description of Artificial Sequence: Synthetic peptide
QQRGNWPIT

SEQ ID NO: 2897 - protein, 5 aa, Artificial Sequence
  Description of Artificial Sequence: Synthetic peptide
IYDMW

SEQ ID NO: 2898 - protein, 17 aa, Artificial Sequence
  Description of Artificial Sequence: Synthetic peptide
VISPSGGSTYYADSVKG

SEQ ID NO: 2899 - protein, 15 aa, Artificial Sequence
  Description of Artificial Sequence: Synthetic peptide
DRAYGDYVGWNGFDY

SEQ ID NO: 2900 - protein, 11 aa, Artificial Sequence
  Description of Artificial Sequence: Synthetic peptide
RASQSISSFLA

SEQ ID NO: 2901 - protein, 7 aa, Artificial Sequence
  Description of Artificial Sequence: Synthetic peptide
DASYRAT

SEQ ID NO: 2902 - protein, 9 aa, Artificial Sequence
  Description of Artificial Sequence: Synthetic peptide
QQRGNWPIT

SEQ ID NO: 2903 - protein, 5 aa, Artificial Sequence
  Description of Artificial Sequence: Synthetic peptide
IYDMW

SEQ ID NO: 2904 - protein, 17 aa, Artificial Sequence
  Description of Artificial Sequence: Synthetic peptide
VIYPSGGATWYADSVKG

SEQ ID NO: 2905 - protein, 15 aa, Artificial Sequence
  Description of Artificial Sequence: Synthetic peptide
DRAYGDYVGWNGFDY

SEQ ID NO: 2906 - protein, 11 aa, Artificial Sequence
  Description of Artificial Sequence: Synthetic peptide
RASQSISSFLA

SEQ ID NO: 2907 - protein, 7 aa, Artificial Sequence
  Description of Artificial Sequence: Synthetic peptide
DASYRAT

SEQ ID NO: 2908 - protein, 9 aa, Artificial Sequence
  Description of Artificial Sequence: Synthetic peptide
QQRGNWPIT

SEQ ID NO: 2909 - protein, 5 aa, Artificial Sequence
  Description of Artificial Sequence: Synthetic peptide
IYDMW

SEQ ID NO: 2910 - protein, 17 aa, Artificial Sequence
  Description of Artificial Sequence: Synthetic peptide
VIYPSGGPTFYADSVKG

SEQ ID NO: 2911 - protein, 15 aa, Artificial Sequence
  Description of Artificial Sequence: Synthetic peptide
DRAYGDYVGWNGFDY

SEQ ID NO: 2912 - protein, 11 aa, Artificial Sequence
  Description of Artificial Sequence: Synthetic peptide
RASQSISSFLA

SEQ ID NO: 2913 - protein, 7 aa, Artificial Sequence
  Description of Artificial Sequence: Synthetic peptide
DASYRAT

SEQ ID NO: 2914 - protein, 9 aa, Artificial Sequence
  Description of Artificial Sequence: Synthetic peptide
QQRGNWPIT

SEQ ID NO: 2915 - protein, 5 aa, Artificial Sequence
  Description of Artificial Sequence: Synthetic peptide
IYDMW

SEQ ID NO: 2916 - protein, 17 aa, Artificial Sequence
  Description of Artificial Sequence: Synthetic peptide
VIYPSGGVTFYADSVKG

SEQ ID NO: 2917 - protein, 15 aa, Artificial Sequence
  Description of Artificial Sequence: Synthetic peptide
DRAYGDYVGWNGFDY

SEQ ID NO: 2918 - protein, 11 aa, Artificial Sequence
  Description of Artificial Sequence: Synthetic peptide
RASQSISSFLA

SEQ ID NO: 2919 - protein, 7 aa, Artificial Sequence
  Description of Artificial Sequence: Synthetic peptide
DASYRAT

SEQ ID NO: 2920 - protein, 9 aa, Artificial Sequence
  Description of Artificial Sequence: Synthetic peptide
QQRGNWPIT

SEQ ID NO: 2921 - protein, 5 aa, Artificial Sequence
  Description of Artificial Sequence: Synthetic peptide
IYDMW

SEQ ID NO: 2922 - protein, 17 aa, Artificial Sequence
  Description of Artificial Sequence: Synthetic peptide
VIYSSGGFTGYADSVKG

SEQ ID NO: 2923 - protein, 15 aa, Artificial Sequence
  Description of Artificial Sequence: Synthetic peptide
DRAYGDYVGWNGFDY

SEQ ID NO: 2924 - protein, 11 aa, Artificial Sequence
  Description of Artificial Sequence: Synthetic peptide
RASQSISSFLA

SEQ ID NO: 2925 - protein, 7 aa, Artificial Sequence
  Description of Artificial Sequence: Synthetic peptide
DASYRAT

SEQ ID NO: 2926 - protein, 9 aa, Artificial Sequence
  Description of Artificial Sequence: Synthetic peptide
QQRGNWPIT

SEQ ID NO: 2927 - protein, 5 aa, Artificial Sequence
  Description of Artificial Sequence: Synthetic peptide
IYPMI

SEQ ID NO: 2928 - protein, 17 aa, Artificial Sequence
  Description of Artificial Sequence: Synthetic peptide
YISPSGGYTSYADSVKG

SEQ ID NO: 2929 - protein, 15 aa, Artificial Sequence
  Description of Artificial Sequence: Synthetic peptide
DRAYGDYVGWNGFDY

SEQ ID NO: 2930 - protein, 11 aa, Artificial Sequence
  Description of Artificial Sequence: Synthetic peptide
RASQSISSFLA

SEQ ID NO: 2931 - protein, 7 aa, Artificial Sequence
  Description of Artificial Sequence: Synthetic peptide
DASYRAT

SEQ ID NO: 2932 - protein, 9 aa, Artificial Sequence
  Description of Artificial Sequence: Synthetic peptide
QQRGNWPIT

SEQ ID NO: 2933 - protein, 5 aa, Artificial Sequence
  Description of Artificial Sequence: Synthetic peptide
IYPMW

SEQ ID NO: 2934 - protein, 17 aa, Artificial Sequence
  Description of Artificial Sequence: Synthetic peptide
YISPSGGFTSYADSVKG

SEQ ID NO: 2935 - protein, 15 aa, Artificial Sequence
  Description of Artificial Sequence: Synthetic peptide
DRAYGDYVGWNGFDY

SEQ ID NO: 2936 - protein, 11 aa, Artificial Sequence
  Description of Artificial Sequence: Synthetic peptide
RASQSISSFLA

SEQ ID NO: 2937 - protein, 7 aa, Artificial Sequence
  Description of Artificial Sequence: Synthetic peptide
DASYRAT

SEQ ID NO: 2938 - protein, 9 aa, Artificial Sequence
  Description of Artificial Sequence: Synthetic peptide
QQRGNWPIT

SEQ ID NO: 2939 - protein, 5 aa, Artificial Sequence
  Description of Artificial Sequence: Synthetic peptide
IYPMW

SEQ ID NO: 2940 - protein, 17 aa, Artificial Sequence
  Description of Artificial Sequence: Synthetic peptide
YISPSGGGTYYADSVKG

SEQ ID NO: 2941 - protein, 15 aa, Artificial Sequence
  Description of Artificial Sequence: Synthetic peptide
DRAYGDYVGWNGFDY

SEQ ID NO: 2942 - protein, 11 aa, Artificial Sequence
  Description of Artificial Sequence: Synthetic peptide
RASQSISSFLA

SEQ ID NO: 2943 - protein, 7 aa, Artificial Sequence
  Description of Artificial Sequence: Synthetic peptide
DASYRAT

SEQ ID NO: 2944 - protein, 9 aa, Artificial Sequence
  Description of Artificial Sequence: Synthetic peptide
QQRGNWPIT

SEQ ID NO: 2945 - protein, 5 aa, Artificial Sequence
  Description of Artificial Sequence: Synthetic peptide
IYPMW

SEQ ID NO: 2946 - protein, 17 aa, Artificial Sequence
  Description of Artificial Sequence: Synthetic peptide
YISSSGGWTDYADSVKG

SEQ ID NO: 2947 - protein, 15 aa, Artificial Sequence
  Description of Artificial Sequence: Synthetic peptide
DRAYGDYVGWNGFDY

SEQ ID NO: 2948 - protein, 11 aa, Artificial Sequence
  Description of Artificial Sequence: Synthetic peptide
RASQSISSFLA

SEQ ID NO: 2949 - protein, 7 aa, Artificial Sequence
  Description of Artificial Sequence: Synthetic peptide
DASYRAT

SEQ ID NO: 2950 - protein, 9 aa, Artificial Sequence
  Description of Artificial Sequence: Synthetic peptide
QQRGNWPIT

SEQ ID NO: 2951 - protein, 5 aa, Artificial Sequence
  Description of Artificial Sequence: Synthetic peptide
IYPMW

SEQ ID NO: 2952 - protein, 17 aa, Artificial Sequence
  Description of Artificial Sequence: Synthetic peptide
YIVPSGGMTYYADSVKG

SEQ ID NO: 2953 - protein, 15 aa, Artificial Sequence
  Description of Artificial Sequence: Synthetic peptide
DRAYGDYVGWNGFDY

SEQ ID NO: 2954 - protein, 11 aa, Artificial Sequence
  Description of Artificial Sequence: Synthetic peptide
RASQSISSFLA

SEQ ID NO: 2955 - protein, 7 aa, Artificial Sequence
  Description of Artificial Sequence: Synthetic peptide
DASYRAT

SEQ ID NO: 2956 - protein, 9 aa, Artificial Sequence
  Description of Artificial Sequence: Synthetic peptide
QQRGNWPIT

SEQ ID NO: 2957 - protein, 5 aa, Artificial Sequence
  Description of Artificial Sequence: Synthetic peptide
IYPMW

SEQ ID NO: 2958 - protein, 17 aa, Artificial Sequence
  Description of Artificial Sequence: Synthetic peptide
YIYPSGGGTFYADSVKG

SEQ ID NO: 2959 - protein, 15 aa, Artificial Sequence
  Description of Artificial Sequence: Synthetic peptide
DRAYGDYVGWNGFDY

SEQ ID NO: 2960 - protein, 11 aa, Artificial Sequence
  Description of Artificial Sequence: Synthetic peptide
RASQSISSFLA

SEQ ID NO: 2961 - protein, 7 aa, Artificial Sequence
  Description of Artificial Sequence: Synthetic peptide
DASYRAT

SEQ ID NO: 2962 - protein, 9 aa, Artificial Sequence
  Description of Artificial Sequence: Synthetic peptide
QQRGNWPIT

SEQ ID NO: 2963 - protein, 5 aa, Artificial Sequence
  Description of Artificial Sequence: Synthetic peptide
KYAMI

SEQ ID NO: 2964 - protein, 17 aa, Artificial Sequence
  Description of Artificial Sequence: Synthetic peptide
WIPPSGGYTSYADSVKG

SEQ ID NO: 2965 - protein, 15 aa, Artificial Sequence
  Description of Artificial Sequence: Synthetic peptide
DRAYGDYVGWNGFDY

SEQ ID NO: 2966 - protein, 11 aa, Artificial Sequence
  Description of Artificial Sequence: Synthetic peptide
RASQSISSFLA

SEQ ID NO: 2967 - protein, 7 aa, Artificial Sequence
  Description of Artificial Sequence: Synthetic peptide
DASYRAT

SEQ ID NO: 2968 - protein, 9 aa, Artificial Sequence
  Description of Artificial Sequence: Synthetic peptide
QQRGNWPIT

SEQ ID NO: 2969 - protein, 5 aa, Artificial Sequence
  Description of Artificial Sequence: Synthetic peptide
KYAMI

SEQ ID NO: 2970 - protein, 17 aa, Artificial Sequence
  Description of Artificial Sequence: Synthetic peptide
YISPSGGFTGYADSVKG

SEQ ID NO: 2971 - protein, 15 aa, Artificial Sequence
  Description of Artificial Sequence: Synthetic peptide
DRAYGDYVGWNGFDY

SEQ ID NO: 2972 - protein, 11 aa, Artificial Sequence
  Description of Artificial Sequence: Synthetic peptide
RASQSISSFLA

SEQ ID NO: 2973 - protein, 7 aa, Artificial Sequence
  Description of Artificial Sequence: Synthetic peptide
DASYRAT

SEQ ID NO: 2974 - protein, 9 aa, Artificial Sequence
  Description of Artificial Sequence: Synthetic peptide
QQRGNWPIT

SEQ ID NO: 2975 - protein, 5 aa, Artificial Sequence
  Description of Artificial Sequence: Synthetic peptide
KYAMI

SEQ ID NO: 2976 - protein, 17 aa, Artificial Sequence
  Description of Artificial Sequence: Synthetic peptide
YISSSGGFTDYADSVKG

SEQ ID NO: 2977 - protein, 15 aa, Artificial Sequence
  Description of Artificial Sequence: Synthetic peptide
DRAYGDYVGWNGFDY

SEQ ID NO: 2978 - protein, 11 aa, Artificial Sequence
  Description of Artificial Sequence: Synthetic peptide
RASQSISSFLA

SEQ ID NO: 2979 - protein, 7 aa, Artificial Sequence
  Description of Artificial Sequence: Synthetic peptide
DASYRAT

SEQ ID NO: 2980 - protein, 9 aa, Artificial Sequence
  Description of Artificial Sequence: Synthetic peptide
QQRGNWPIT

SEQ ID NO: 2981 - protein, 5 aa, Artificial Sequence
  Description of Artificial Sequence: Synthetic peptide
KYAMW

SEQ ID NO: 2982 - protein, 17 aa, Artificial Sequence
  Description of Artificial Sequence: Synthetic peptide
SISPSGGGTFYADSVKG

SEQ ID NO: 2983 - protein, 15 aa, Artificial Sequence
  Description of Artificial Sequence: Synthetic peptide
DRAYGDYVGWNGFDY

SEQ ID NO: 2984 - protein, 11 aa, Artificial Sequence
  Description of Artificial Sequence: Synthetic peptide
RASQSISSFLA

SEQ ID NO: 2985 - protein, 7 aa, Artificial Sequence
  Description of Artificial Sequence: Synthetic peptide
DASYRAT

SEQ ID NO: 2986 - protein, 9 aa, Artificial Sequence
  Description of Artificial Sequence: Synthetic peptide
QQRGNWPIT

SEQ ID NO: 2987 - protein, 5 aa, Artificial Sequence
  Description of Artificial Sequence: Synthetic peptide
KYAMW

SEQ ID NO: 2988 - protein, 17 aa, Artificial Sequence
  Description of Artificial Sequence: Synthetic peptide
YIVPSGGRTFYADSVKG

SEQ ID NO: 2989 - protein, 15 aa, Artificial Sequence
  Description of Artificial Sequence: Synthetic peptide
DRAYGDYVGWNGFDY

SEQ ID NO: 2990 - protein, 11 aa, Artificial Sequence
  Description of Artificial Sequence: Synthetic peptide
RASQSISSFLA

SEQ ID NO: 2991 - protein, 7 aa, Artificial Sequence
  Description of Artificial Sequence: Synthetic peptide
DASYRAT

SEQ ID NO: 2992 - protein, 9 aa, Artificial Sequence
  Description of Artificial Sequence: Synthetic peptide
QQRGNWPIT

SEQ ID NO: 2993 - protein, 5 aa, Artificial Sequence
  Description of Artificial Sequence: Synthetic peptide
KYDMF

SEQ ID NO: 2994 - protein, 17 aa, Artificial Sequence
  Description of Artificial Sequence: Synthetic peptide
SIVPSGGATYYADSVKG

SEQ ID NO: 2995 - protein, 15 aa, Artificial Sequence
  Description of Artificial Sequence: Synthetic peptide
DRAYGDYVGWNGFDY

SEQ ID NO: 2996 - protein, 11 aa, Artificial Sequence
  Description of Artificial Sequence: Synthetic peptide
RASQSISSFLA

SEQ ID NO: 2997 - protein, 7 aa, Artificial Sequence
  Description of Artificial Sequence: Synthetic peptide
DASYRAT

SEQ ID NO: 2998 - protein, 9 aa, Artificial Sequence
  Description of Artificial Sequence: Synthetic peptide
QQRGNWPIT

SEQ ID NO: 2999 - protein, 5 aa, Artificial Sequence
  Description of Artificial Sequence: Synthetic peptide
KYDMI

SEQ ID NO: 3000 - protein, 17 aa, Artificial Sequence
  Description of Artificial Sequence: Synthetic peptide
WIGPSGGATMYADSVKG

SEQ ID NO: 3001 - protein, 15 aa, Artificial Sequence
  Description of Artificial Sequence: Synthetic peptide
DRAYGDYVGWNGFDY

SEQ ID NO: 3002 - protein, 11 aa, Artificial Sequence
  Description of Artificial Sequence: Synthetic peptide
RASQSISSFLA

SEQ ID NO: 3003 - protein, 7 aa, Artificial Sequence
  Description of Artificial Sequence: Synthetic peptide
DASYRAT

SEQ ID NO: 3004 - protein, 9 aa, Artificial Sequence
  Description of Artificial Sequence: Synthetic peptide
QQRGNWPIT

SEQ ID NO: 3005 - protein, 5 aa, Artificial Sequence
  Description of Artificial Sequence: Synthetic peptide
KYDMI

SEQ ID NO: 3006 - protein, 17 aa, Artificial Sequence
  Description of Artificial Sequence: Synthetic peptide
YIGSSGGYTGYADSVKG

SEQ ID NO: 3007 - protein, 15 aa, Artificial Sequence
  Description of Artificial Sequence: Synthetic peptide
DRAYGDYVGWNGFDY

SEQ ID NO: 3008 - protein, 11 aa, Artificial Sequence
  Description of Artificial Sequence: Synthetic peptide
RASQSISSFLA

SEQ ID NO: 3009 - protein, 7 aa, Artificial Sequence
  Description of Artificial Sequence: Synthetic peptide
DASYRAT

SEQ ID NO: 3010 - protein, 9 aa, Artificial Sequence
  Description of Artificial Sequence: Synthetic peptide
QQRGNWPIT

SEQ ID NO: 3011 - protein, 5 aa, Artificial Sequence
  Description of Artificial Sequence: Synthetic peptide
KYDMW

SEQ ID NO: 3012 - protein, 17 aa, Artificial Sequence
  Description of Artificial Sequence: Synthetic peptide
SISSSGGGTFYADSVKG

SEQ ID NO: 3013 - protein, 15 aa, Artificial Sequence
  Description of Artificial Sequence: Synthetic peptide
DRAYGDYVGWNGFDY

SEQ ID NO: 3014 - protein, 11 aa, Artificial Sequence
  Description of Artificial Sequence: Synthetic peptide
RASQSISSFLA

SEQ ID NO: 3015 - protein, 7 aa, Artificial Sequence
  Description of Artificial Sequence: Synthetic peptide
DASYRAT

SEQ ID NO: 3016 - protein, 9 aa, Artificial Sequence
  Description of Artificial Sequence: Synthetic peptide
QQRGNWPIT

SEQ ID NO: 3017 - protein, 5 aa, Artificial Sequence
  Description of Artificial Sequence: Synthetic peptide
KYDMW

SEQ ID NO: 3018 - protein, 17 aa, Artificial Sequence
  Description of Artificial Sequence: Synthetic peptide
VIYPSGGPTFYADSVKG

SEQ ID NO: 3019 - protein, 15 aa, Artificial Sequence
  Description of Artificial Sequence: Synthetic peptide
DRAYGDYVGWNGFDY

SEQ ID NO: 3020 - protein, 11 aa, Artificial Sequence
  Description of Artificial Sequence: Synthetic peptide
RASQSISSFLA

SEQ ID NO: 3021 - protein, 7 aa, Artificial Sequence
  Description of Artificial Sequence: Synthetic peptide
DASYRAT

SEQ ID NO: 3022 - protein, 9 aa, Artificial Sequence
  Description of Artificial Sequence: Synthetic peptide
QQRGNWPIT

SEQ ID NO: 3023 - protein, 5 aa, Artificial Sequence
  Description of Artificial Sequence: Synthetic peptide
KYDMW

SEQ ID NO: 3024 - protein, 17 aa, Artificial Sequence
  Description of Artificial Sequence: Synthetic peptide
VIYPSGGQTYYADSVKG

SEQ ID NO: 3025 - protein, 15 aa, Artificial Sequence
  Description of Artificial Sequence: Synthetic peptide
DRAYGDYVGWNGFDY

SEQ ID NO: 3026 - protein, 11 aa, Artificial Sequence
  Description of Artificial Sequence: Synthetic peptide
RASQSISSFLA

SEQ ID NO: 3027 - protein, 7 aa, Artificial Sequence
  Description of Artificial Sequence: Synthetic peptide
DASYRAT

SEQ ID NO: 3028 - protein, 9 aa, Artificial Sequence
  Description of Artificial Sequence: Synthetic peptide
QQRGNWPIT

SEQ ID NO: 3029 - protein, 5 aa, Artificial Sequence
  Description of Artificial Sequence: Synthetic peptide
KYDMW

SEQ ID NO: 3030 - protein, 17 aa, Artificial Sequence
  Description of Artificial Sequence: Synthetic peptide
VIYPSGGSTYYADSVKG

SEQ ID NO: 3031 - protein, 15 aa, Artificial Sequence
  Description of Artificial Sequence: Synthetic peptide
DRAYGDYVGWNGFDY

SEQ ID NO: 3032 - protein, 11 aa, Artificial Sequence
  Description of Artificial Sequence: Synthetic peptide
RASQSISSFLA

SEQ ID NO: 3033 - protein, 7 aa, Artificial Sequence
  Description of Artificial Sequence: Synthetic peptide
DASYRAT

SEQ ID NO: 3034 - protein, 9 aa, Artificial Sequence
  Description of Artificial Sequence: Synthetic peptide
QQRGNWPIT

SEQ ID NO: 3035 - protein, 5 aa, Artificial Sequence
  Description of Artificial Sequence: Synthetic peptide
KYDMW

SEQ ID NO: 3036 - protein, 17 aa, Artificial Sequence
  Description of Artificial Sequence: Synthetic peptide
VIYSSGGFTLYADSVKG

SEQ ID NO: 3037 - protein, 15 aa, Artificial Sequence
  Description of Artificial Sequence: Synthetic peptide
DRAYGDYVGWNGFDY

SEQ ID NO: 3038 - protein, 11 aa, Artificial Sequence
  Description of Artificial Sequence: Synthetic peptide
RASQSISSFLA

SEQ ID NO: 3039 - protein, 7 aa, Artificial Sequence
  Description of Artificial Sequence: Synthetic peptide
DASYRAT

SEQ ID NO: 3040 - protein, 9 aa, Artificial Sequence
  Description of Artificial Sequence: Synthetic peptide
QQRGNWPIT

SEQ ID NO: 3041 - protein, 5 aa, Artificial Sequence
  Description of Artificial Sequence: Synthetic peptide
KYDMW

SEQ ID NO: 3042 - protein, 17 aa, Artificial Sequence
  Description of Artificial Sequence: Synthetic peptide
VIYSSGGFTSYADSVKG

SEQ ID NO: 3043 - protein, 15 aa, Artificial Sequence
  Description of Artificial Sequence: Synthetic peptide
DRAYGDYVGWNGFDY

SEQ ID NO: 3044 - protein, 11 aa, Artificial Sequence
  Description of Artificial Sequence: Synthetic peptide
RASQSISSFLA

SEQ ID NO: 3045 - protein, 7 aa, Artificial Sequence
  Description of Artificial Sequence: Synthetic peptide
DASYRAT

SEQ ID NO: 3046 - protein, 9 aa, Artificial Sequence
  Description of Artificial Sequence: Synthetic peptide
QQRGNWPIT

SEQ ID NO: 3047 - protein, 5 aa, Artificial Sequence
  Description of Artificial Sequence: Synthetic peptide
KYDMW

SEQ ID NO: 3048 - protein, 17 aa, Artificial Sequence
  Description of Artificial Sequence: Synthetic peptide
VIYSSGGPTFYADSVKG

SEQ ID NO: 3049 - protein, 15 aa, Artificial Sequence
  Description of Artificial Sequence: Synthetic peptide
DRAYGDYVGWNGFDY

SEQ ID NO: 3050 - protein, 11 aa, Artificial Sequence
  Description of Artificial Sequence: Synthetic peptide
RASQSISSFLA

SEQ ID NO: 3051 - protein, 7 aa, Artificial Sequence
  Description of Artificial Sequence: Synthetic peptide
DASYRAT

SEQ ID NO: 3052 - protein, 9 aa, Artificial Sequence
  Description of Artificial Sequence: Synthetic peptide
QQRGNWPIT

SEQ ID NO: 3053 - protein, 5 aa, Artificial Sequence
  Description of Artificial Sequence: Synthetic peptide
KYDMW

SEQ ID NO: 3054 - protein, 17 aa, Artificial Sequence
  Description of Artificial Sequence: Synthetic peptide
YIGPSGGFTDYADSVKG

SEQ ID NO: 3055 - protein, 15 aa, Artificial Sequence
  Description of Artificial Sequence: Synthetic peptide
DRAYGDYVGWNGFDY

SEQ ID NO: 3056 - protein, 11 aa, Artificial Sequence
  Description of Artificial Sequence: Synthetic peptide
RASQSISSFLA

SEQ ID NO: 3057 - protein, 7 aa, Artificial Sequence
  Description of Artificial Sequence: Synthetic peptide
DASYRAT

SEQ ID NO: 3058 - protein, 9 aa, Artificial Sequence
  Description of Artificial Sequence: Synthetic peptide
QQRGNWPIT

SEQ ID NO: 3059 - protein, 5 aa, Artificial Sequence
  Description of Artificial Sequence: Synthetic peptide
KYDMW

SEQ ID NO: 3060 - protein, 17 aa, Artificial Sequence
  Description of Artificial Sequence: Synthetic peptide
YISSSGGFTDYADSVKG

SEQ ID NO: 3061 - protein, 15 aa, Artificial Sequence
  Description of Artificial Sequence: Synthetic peptide
DRAYGDYVGWNGFDY

SEQ ID NO: 3062 - protein, 11 aa, Artificial Sequence
  Description of Artificial Sequence: Synthetic peptide
RASQSISSFLA

SEQ ID NO: 3063 - protein, 7 aa, Artificial Sequence
  Description of Artificial Sequence: Synthetic peptide
DASYRAT

SEQ ID NO: 3064 - protein, 9 aa, Artificial Sequence
  Description of Artificial Sequence: Synthetic peptide
QQRGNWPIT

SEQ ID NO: 3065 - protein, 5 aa, Artificial Sequence
  Description of Artificial Sequence: Synthetic peptide
KYDMW

SEQ ID NO: 3066 - protein, 17 aa, Artificial Sequence
  Description of Artificial Sequence: Synthetic peptide
YIVPSGGFIDYADSVKG

SEQ ID NO: 3067 - protein, 15 aa, Artificial Sequence
  Description of Artificial Sequence: Synthetic peptide
DRAYGDYVGWNGFDY

SEQ ID NO: 3068 - protein, 11 aa, Artificial Sequence
  Description of Artificial Sequence: Synthetic peptide
RASQSISSFLA

SEQ ID NO: 3069 - protein, 7 aa, Artificial Sequence
  Description of Artificial Sequence: Synthetic peptide
DASYRAT

SEQ ID NO: 3070 - protein, 9 aa, Artificial Sequence
  Description of Artificial Sequence: Synthetic peptide
QQRGNWPIT

SEQ ID NO: 3071 - protein, 5 aa, Artificial Sequence
  Description of Artificial Sequence: Synthetic peptide
KYEMF

SEQ ID NO: 3072 - protein, 17 aa, Artificial Sequence
  Description of Artificial Sequence: Synthetic peptide
SISSSGGGTFYADSVKG

SEQ ID NO: 3073 - protein, 15 aa, Artificial Sequence
  Description of Artificial Sequence: Synthetic peptide
DRAYGDYVGWNGFDY

SEQ ID NO: 3074 - protein, 11 aa, Artificial Sequence
  Description of Artificial Sequence: Synthetic peptide
RASQSISSFLA

SEQ ID NO: 3075 - protein, 7 aa, Artificial Sequence
  Description of Artificial Sequence: Synthetic peptide
DASYRAT

SEQ ID NO: 3076 - protein, 9 aa, Artificial Sequence
  Description of Artificial Sequence: Synthetic peptide
QQRGNWPIT

SEQ ID NO: 3077 - protein, 5 aa, Artificial Sequence
  Description of Artificial Sequence: Synthetic peptide
KYEMW

SEQ ID NO: 3078 - protein, 17 aa, Artificial Sequence
  Description of Artificial Sequence: Synthetic peptide
VIYPSGGMTYYADSVKG

SEQ ID NO: 3079 - protein, 15 aa, Artificial Sequence
  Description of Artificial Sequence: Synthetic peptide
DRAYGDYVGWNGFDY

SEQ ID NO: 3080 - protein, 11 aa, Artificial Sequence
  Description of Artificial Sequence: Synthetic peptide
RASQSISSFLA

SEQ ID NO: 3081 - protein, 7 aa, Artificial Sequence
  Description of Artificial Sequence: Synthetic peptide
DASYRAT

SEQ ID NO: 3082 - protein, 9 aa, Artificial Sequence
  Description of Artificial Sequence: Synthetic peptide
QQRGNWPIT

SEQ ID NO: 3083 - protein, 5 aa, Artificial Sequence
  Description of Artificial Sequence: Synthetic peptide
KYEMW

SEQ ID NO: 3084 - protein, 17 aa, Artificial Sequence
  Description of Artificial Sequence: Synthetic peptide
VIYPSGGYTGYADSVKG

SEQ ID NO: 3085 - protein, 15 aa, Artificial Sequence
  Description of Artificial Sequence: Synthetic peptide
DRAYGDYVGWNGFDY

SEQ ID NO: 3086 - protein, 11 aa, Artificial Sequence
  Description of Artificial Sequence: Synthetic peptide
RASQSISSFLA

SEQ ID NO: 3087 - protein, 7 aa, Artificial Sequence
  Description of Artificial Sequence: Synthetic peptide
DASYRAT

SEQ ID NO: 3088 - protein, 9 aa, Artificial Sequence
  Description of Artificial Sequence: Synthetic peptide
QQRGNWPIT

SEQ ID NO: 3089 - protein, 5 aa, Artificial Sequence
  Description of Artificial Sequence: Synthetic peptide
KYEMW

SEQ ID NO: 3090 - protein, 17 aa, Artificial Sequence
  Description of Artificial Sequence: Synthetic peptide
VIYSSGGKTYYADSVKG

SEQ ID NO: 3091 - protein, 15 aa, Artificial Sequence
  Description of Artificial Sequence: Synthetic peptide
DRAYGDYVGWNGFDY

SEQ ID NO: 3092 - protein, 11 aa, Artificial Sequence
  Description of Artificial Sequence: Synthetic peptide
RASQSISSFLA

SEQ ID NO: 3093 - protein, 7 aa, Artificial Sequence
  Description of Artificial Sequence: Synthetic peptide
DASYRAT

SEQ ID NO: 3094 - protein, 9 aa, Artificial Sequence
  Description of Artificial Sequence: Synthetic peptide
QQRGNWPIT

SEQ ID NO: 3095 - protein, 5 aa, Artificial Sequence
  Description of Artificial Sequence: Synthetic peptide
KYEMW

SEQ ID NO: 3096 - protein, 17 aa, Artificial Sequence
  Description of Artificial Sequence: Synthetic peptide
YIGPSGGFTDYADSVKG

SEQ ID NO: 3097 - protein, 15 aa, Artificial Sequence
  Description of Artificial Sequence: Synthetic peptide
DRAYGDYVGWNGFDY

SEQ ID NO: 3098 - protein, 11 aa, Artificial Sequence
  Description of Artificial Sequence: Synthetic peptide
RASQSISSFLA

SEQ ID NO: 3099 - protein, 7 aa, Artificial Sequence
  Description of Artificial Sequence: Synthetic peptide
DASYRAT

SEQ ID NO: 3100 - protein, 9 aa, Artificial Sequence
  Description of Artificial Sequence: Synthetic peptide
QQRGNWPIT

SEQ ID NO: 3101 - protein, 5 aa, Artificial Sequence
  Description of Artificial Sequence: Synthetic peptide
KYEMW

SEQ ID NO: 3102 - protein, 17 aa, Artificial Sequence
  Description of Artificial Sequence: Synthetic peptide
YIGPSGGITMYADSVKG

SEQ ID NO: 3103 - protein, 15 aa, Artificial Sequence
  Description of Artificial Sequence: Synthetic peptide
DRAYGDYVGWNGFDY

SEQ ID NO: 3104 - protein, 11 aa, Artificial Sequence
  Description of Artificial Sequence: Synthetic peptide
RASQSISSFLA

SEQ ID NO: 3105 - protein, 7 aa, Artificial Sequence
  Description of Artificial Sequence: Synthetic peptide
DASYRAT

SEQ ID NO: 3106 - protein, 9 aa, Artificial Sequence
  Description of Artificial Sequence: Synthetic peptide
QQRGNWPIT

SEQ ID NO: 3107 - protein, 5 aa, Artificial Sequence
  Description of Artificial Sequence: Synthetic peptide
KYEMW

SEQ ID NO: 3108 - protein, 17 aa, Artificial Sequence
  Description of Artificial Sequence: Synthetic peptide
YISPSGGGTLYADSVKG

SEQ ID NO: 3109 - protein, 15 aa, Artificial Sequence
  Description of Artificial Sequence: Synthetic peptide
DRAYGDYVGWNGFDY

SEQ ID NO: 3110 - protein, 11 aa, Artificial Sequence
  Description of Artificial Sequence: Synthetic peptide
RASQSISSFLA

SEQ ID NO: 3111 - protein, 7 aa, Artificial Sequence
  Description of Artificial Sequence: Synthetic peptide
DASYRAT

SEQ ID NO: 3112 - protein, 9 aa, Artificial Sequence
  Description of Artificial Sequence: Synthetic peptide
QQRGNWPIT

SEQ ID NO: 3113 - protein, 5 aa, Artificial Sequence
  Description of Artificial Sequence: Synthetic peptide
KYMMF

SEQ ID NO: 3114 - protein, 17 aa, Artificial Sequence
  Description of Artificial Sequence: Synthetic peptide
SIYSSGGRTFYADSVKG

SEQ ID NO: 3115 - protein, 15 aa, Artificial Sequence
  Description of Artificial Sequence: Synthetic peptide
DRAYGDYVGWNGFDY

SEQ ID NO: 3116 - protein, 11 aa, Artificial Sequence
  Description of Artificial Sequence: Synthetic peptide
RASQSISSFLA

SEQ ID NO: 3117 - protein, 7 aa, Artificial Sequence
  Description of Artificial Sequence: Synthetic peptide
DASYRAT

SEQ ID NO: 3118 - protein, 9 aa, Artificial Sequence
  Description of Artificial Sequence: Synthetic peptide
QQRGNWPIT

SEQ ID NO: 3119 - protein, 5 aa, Artificial Sequence
  Description of Artificial Sequence: Synthetic peptide
KYNMW

SEQ ID NO: 3120 - protein, 17 aa, Artificial Sequence
  Description of Artificial Sequence: Synthetic peptide
SIYPSGGATFYADSVKG

SEQ ID NO: 3121 - protein, 15 aa, Artificial Sequence
  Description of Artificial Sequence: Synthetic peptide
DRAYGDYVGWNGFDY

SEQ ID NO: 3122 - protein, 11 aa, Artificial Sequence
  Description of Artificial Sequence: Synthetic peptide
RASQSISSFLA

SEQ ID NO: 3123 - protein, 7 aa, Artificial Sequence
  Description of Artificial Sequence: Synthetic peptide
DASYRAT

SEQ ID NO: 3124 - protein, 9 aa, Artificial Sequence
  Description of Artificial Sequence: Synthetic peptide
QQRGNWPIT

SEQ ID NO: 3125 - protein, 5 aa, Artificial Sequence
  Description of Artificial Sequence: Synthetic peptide
KYNMW

SEQ ID NO: 3126 - protein, 17 aa, Artificial Sequence
  Description of Artificial Sequence: Synthetic peptide
VIYPSGGATFYADSVKG

SEQ ID NO: 3127 - protein, 15 aa, Artificial Sequence
  Description of Artificial Sequence: Synthetic peptide
DRAYGDYVGWNGFDY

SEQ ID NO: 3128 - protein, 11 aa, Artificial Sequence
  Description of Artificial Sequence: Synthetic peptide
RASQSISSFLA

SEQ ID NO: 3129 - protein, 7 aa, Artificial Sequence
  Description of Artificial Sequence: Synthetic peptide
DASYRAT

SEQ ID NO: 3130 - protein, 9 aa, Artificial Sequence
  Description of Artificial Sequence: Synthetic peptide
QQRGNWPIT

SEQ ID NO: 3131 - protein, 5 aa, Artificial Sequence
  Description of Artificial Sequence: Synthetic peptide
KYPMF

SEQ ID NO: 3132 - protein, 17 aa, Artificial Sequence
  Description of Artificial Sequence: Synthetic peptide
YIVPSGGYTSYADSVKG

SEQ ID NO: 3133 - protein, 15 aa, Artificial Sequence
  Description of Artificial Sequence: Synthetic peptide
DRAYGDYVGWNGFDY

SEQ ID NO: 3134 - protein, 11 aa, Artificial Sequence
  Description of Artificial Sequence: Synthetic peptide
RASQSISSFLA

SEQ ID NO: 3135 - protein, 7 aa, Artificial Sequence
  Description of Artificial Sequence: Synthetic peptide
DASYRAT

SEQ ID NO: 3136 - protein, 9 aa, Artificial Sequence
  Description of Artificial Sequence: Synthetic peptide
QQRGNWPIT

SEQ ID NO: 3137 - protein, 5 aa, Artificial Sequence
  Description of Artificial Sequence: Synthetic peptide
KYPMI

SEQ ID NO: 3138 - protein, 17 aa, Artificial Sequence
  Description of Artificial Sequence: Synthetic peptide
YISPSGGYTGYADSVKG

SEQ ID NO: 3139 - protein, 15 aa, Artificial Sequence
  Description of Artificial Sequence: Synthetic peptide
DRAYGDYVGWNGFDY

SEQ ID NO: 3140 - protein, 11 aa, Artificial Sequence
  Description of Artificial Sequence: Synthetic peptide
RASQSISSFLA

SEQ ID NO: 3141 - protein, 7 aa, Artificial Sequence
  Description of Artificial Sequence: Synthetic peptide
DASYRAT

SEQ ID NO: 3142 - protein, 9 aa, Artificial Sequence
  Description of Artificial Sequence: Synthetic peptide
QQRGNWPIT

SEQ ID NO: 3143 - protein, 5 aa, Artificial Sequence
  Description of Artificial Sequence: Synthetic peptide
KYPMI

SEQ ID NO: 3144 - protein, 17 aa, Artificial Sequence
  Description of Artificial Sequence: Synthetic peptide
YISPSGGYTSYADSVKG

SEQ ID NO: 3145 - protein, 15 aa, Artificial Sequence
  Description of Artificial Sequence: Synthetic peptide
DRAYGDYVGWNGFDY

SEQ ID NO: 3146 - protein, 11 aa, Artificial Sequence
  Description of Artificial Sequence: Synthetic peptide
RASQSISSFLA

SEQ ID NO: 3147 - protein, 7 aa, Artificial Sequence
  Description of Artificial Sequence: Synthetic peptide
DASYRAT

SEQ ID NO: 3148 - protein, 9 aa, Artificial Sequence
  Description of Artificial Sequence: Synthetic peptide
QQRGNWPIT

SEQ ID NO: 3149 - protein, 5 aa, Artificial Sequence
  Description of Artificial Sequence: Synthetic peptide
KYPMI

SEQ ID NO: 3150 - protein, 17 aa, Artificial Sequence
  Description of Artificial Sequence: Synthetic peptide
YISSSGGWTDYADSVKG

SEQ ID NO: 3151 - protein, 15 aa, Artificial Sequence
  Description of Artificial Sequence: Synthetic peptide
DRAYGDYVGWNGFDY

SEQ ID NO: 3152 - protein, 11 aa, Artificial Sequence
  Description of Artificial Sequence: Synthetic peptide
RASQSISSFLA

SEQ ID NO: 3153 - protein, 7 aa, Artificial Sequence
  Description of Artificial Sequence: Synthetic peptide
DASYRAT

SEQ ID NO: 3154 - protein, 9 aa, Artificial Sequence
  Description of Artificial Sequence: Synthetic peptide
QQRGNWPIT

SEQ ID NO: 3155 - protein, 5 aa, Artificial Sequence
  Description of Artificial Sequence: Synthetic peptide
KYPMI

SEQ ID NO: 3156 - protein, 17 aa, Artificial Sequence
  Description of Artificial Sequence: Synthetic peptide
YIYPSGGATYYADSVKG

SEQ ID NO: 3157 - protein, 15 aa, Artificial Sequence
  Description of Artificial Sequence: Synthetic peptide
DRAYGDYVGWNGFDY

SEQ ID NO: 3158 - protein, 11 aa, Artificial Sequence
  Description of Artificial Sequence: Synthetic peptide
RASQSISSFLA

SEQ ID NO: 3159 - protein, 7 aa, Artificial Sequence
  Description of Artificial Sequence: Synthetic peptide
DASYRAT

SEQ ID NO: 3160 - protein, 9 aa, Artificial Sequence
  Description of Artificial Sequence: Synthetic peptide
QQRGNWPIT

SEQ ID NO: 3161 - protein, 5 aa, Artificial Sequence
  Description of Artificial Sequence: Synthetic peptide
KYPMI

SEQ ID NO: 3162 - protein, 17 aa, Artificial Sequence
  Description of Artificial Sequence: Synthetic peptide
YIYPSGGYTSYADSVKG

SEQ ID NO: 3163 - protein, 15 aa, Artificial Sequence
  Description of Artificial Sequence: Synthetic peptide
DRAYGDYVGWNGFDY

SEQ ID NO: 3164 - protein, 11 aa, Artificial Sequence
  Description of Artificial Sequence: Synthetic peptide
RASQSISSFLA

SEQ ID NO: 3165 - protein, 7 aa, Artificial Sequence
  Description of Artificial Sequence: Synthetic peptide
DASYRAT

SEQ ID NO: 3166 - protein, 9 aa, Artificial Sequence
  Description of Artificial Sequence: Synthetic peptide
QQRGNWPIT

SEQ ID NO: 3167 - protein, 5 aa, Artificial Sequence
  Description of Artificial Sequence: Synthetic peptide
KYPMI

SEQ ID NO: 3168 - protein, 17 aa, Artificial Sequence
  Description of Artificial Sequence: Synthetic peptide
YIYSSGGGTYYADSVKG

SEQ ID NO: 3169 - protein, 15 aa, Artificial Sequence
  Description of Artificial Sequence: Synthetic peptide
DRAYGDYVGWNGFDY

SEQ ID NO: 3170 - protein, 11 aa, Artificial Sequence
  Description of Artificial Sequence: Synthetic peptide
RASQSISSFLA

SEQ ID NO: 3171 - protein, 7 aa, Artificial Sequence
  Description of Artificial Sequence: Synthetic peptide
DASYRAT

SEQ ID NO: 3172 - protein, 9 aa, Artificial Sequence
  Description of Artificial Sequence: Synthetic peptide
QQRGNWPIT

SEQ ID NO: 3173 - protein, 5 aa, Artificial Sequence
  Description of Artificial Sequence: Synthetic peptide
KYPMM

SEQ ID NO: 3174 - protein, 17 aa, Artificial Sequence
  Description of Artificial Sequence: Synthetic peptide
YISPSGGFTDYADSVKG

SEQ ID NO: 3175 - protein, 15 aa, Artificial Sequence
  Description of Artificial Sequence: Synthetic peptide
DRAYGDYVGWNGFDY

SEQ ID NO: 3176 - protein, 11 aa, Artificial Sequence
  Description of Artificial Sequence: Synthetic peptide
RASQSISSFLA

SEQ ID NO: 3177 - protein, 7 aa, Artificial Sequence
  Description of Artificial Sequence: Synthetic peptide
DASYRAT

SEQ ID NO: 3178 - protein, 9 aa, Artificial Sequence
  Description of Artificial Sequence: Synthetic peptide
QQRGNWPIT

SEQ ID NO: 3179 - protein, 5 aa, Artificial Sequence
  Description of Artificial Sequence: Synthetic peptide
KYPMM

SEQ ID NO: 3180 - protein, 17 aa, Artificial Sequence
  Description of Artificial Sequence: Synthetic peptide
YIYPSGGYTDYADSVKG

SEQ ID NO: 3181 - protein, 15 aa, Artificial Sequence
  Description of Artificial Sequence: Synthetic peptide
DRAYGDYVGWNGFDY

SEQ ID NO: 3182 - protein, 11 aa, Artificial Sequence
  Description of Artificial Sequence: Synthetic peptide
RASQSISSFLA

SEQ ID NO: 3183 - protein, 7 aa, Artificial Sequence
  Description of Artificial Sequence: Synthetic peptide
DASYRAT

SEQ ID NO: 3184 - protein, 9 aa, Artificial Sequence
  Description of Artificial Sequence: Synthetic peptide
QQRGNWPIT

SEQ ID NO: 3185 - protein, 5 aa, Artificial Sequence
  Description of Artificial Sequence: Synthetic peptide
KYPMM

SEQ ID NO: 3186 - protein, 17 aa, Artificial Sequence
  Description of Artificial Sequence: Synthetic peptide
YIYPSGGYTGYADSVKG

SEQ ID NO: 3187 - protein, 15 aa, Artificial Sequence
  Description of Artificial Sequence: Synthetic peptide
DRAYGDYVGWNGFDY

SEQ ID NO: 3188 - protein, 11 aa, Artificial Sequence
  Description of Artificial Sequence: Synthetic peptide
RASQSISSFLA

SEQ ID NO: 3189 - protein, 7 aa, Artificial Sequence
  Description of Artificial Sequence: Synthetic peptide
DASYRAT

SEQ ID NO: 3190 - protein, 9 aa, Artificial Sequence
  Description of Artificial Sequence: Synthetic peptide
QQRGNWPIT

SEQ ID NO: 3191 - protein, 5 aa, Artificial Sequence
  Description of Artificial Sequence: Synthetic peptide
KYPMW

SEQ ID NO: 3192 - protein, 17 aa, Artificial Sequence
  Description of Artificial Sequence: Synthetic peptide
SIVSSGGATYYTDSVKG

SEQ ID NO: 3193 - protein, 15 aa, Artificial Sequence
  Description of Artificial Sequence: Synthetic peptide
DRAYGDYVGWNGFDY

SEQ ID NO: 3194 - protein, 11 aa, Artificial Sequence
  Description of Artificial Sequence: Synthetic peptide
RASQSISSFLA

SEQ ID NO: 3195 - protein, 7 aa, Artificial Sequence
  Description of Artificial Sequence: Synthetic peptide
DASYRAT

SEQ ID NO: 3196 - protein, 9 aa, Artificial Sequence
  Description of Artificial Sequence: Synthetic peptide
QQRGNWPIT

SEQ ID NO: 3197 - protein, 5 aa, Artificial Sequence
  Description of Artificial Sequence: Synthetic peptide
KYPMW

SEQ ID NO: 3198 - protein, 17 aa, Artificial Sequence
  Description of Artificial Sequence: Synthetic peptide
SIYPSGGYTGYADSVKG

SEQ ID NO: 3199 - protein, 15 aa, Artificial Sequence
  Description of Artificial Sequence: Synthetic peptide
DRAYGDYVGWNGFDY

SEQ ID NO: 3200 - protein, 11 aa, Artificial Sequence
  Description of Artificial Sequence: Synthetic peptide
RASQSISSFLA

SEQ ID NO: 3201 - protein, 7 aa, Artificial Sequence
  Description of Artificial Sequence: Synthetic peptide
DASYRAT

SEQ ID NO: 3202 - protein, 9 aa, Artificial Sequence
  Description of Artificial Sequence: Synthetic peptide
QQRGNWPIT

SEQ ID NO: 3203 - protein, 5 aa, Artificial Sequence
  Description of Artificial Sequence: Synthetic peptide
KYPMW

SEQ ID NO: 3204 - protein, 17 aa, Artificial Sequence
  Description of Artificial Sequence: Synthetic peptide
VISPSGGATYYADSVKG

SEQ ID NO: 3205 - protein, 15 aa, Artificial Sequence
  Description of Artificial Sequence: Synthetic peptide
DRAYGDYVGWNGFDY

SEQ ID NO: 3206 - protein, 11 aa, Artificial Sequence
  Description of Artificial Sequence: Synthetic peptide
RASQSISSFLA

SEQ ID NO: 3207 - protein, 7 aa, Artificial Sequence
  Description of Artificial Sequence: Synthetic peptide
DASYRAT

SEQ ID NO: 3208 - protein, 9 aa, Artificial Sequence
  Description of Artificial Sequence: Synthetic peptide
QQRGNWPIT

SEQ ID NO: 3209 - protein, 5 aa, Artificial Sequence
  Description of Artificial Sequence: Synthetic peptide
KYPMW

SEQ ID NO: 3210 - protein, 17 aa, Artificial Sequence
  Description of Artificial Sequence: Synthetic peptide
VIYPSGGYTAYADSVKG

SEQ ID NO: 3211 - protein, 15 aa, Artificial Sequence
  Description of Artificial Sequence: Synthetic peptide
DRAYGDYVGWNGFDY

SEQ ID NO: 3212 - protein, 11 aa, Artificial Sequence
  Description of Artificial Sequence: Synthetic peptide
RASQSISSFLA

SEQ ID NO: 3213 - protein, 7 aa, Artificial Sequence
  Description of Artificial Sequence: Synthetic peptide
DASYRAT

SEQ ID NO: 3214 - protein, 9 aa, Artificial Sequence
  Description of Artificial Sequence: Synthetic peptide
QQRGNWPIT

SEQ ID NO: 3215 - protein, 5 aa, Artificial Sequence
  Description of Artificial Sequence: Synthetic peptide
KYPMW

SEQ ID NO: 3216 - protein, 17 aa, Artificial Sequence
  Description of Artificial Sequence: Synthetic peptide
VIYSSGGGTFYADSVKG

SEQ ID NO: 3217 - protein, 15 aa, Artificial Sequence
  Description of Artificial Sequence: Synthetic peptide
DRAYGDYVGWNGFDY

SEQ ID NO: 3218 - protein, 11 aa, Artificial Sequence
  Description of Artificial Sequence: Synthetic peptide
RASQSISSFLA

SEQ ID NO: 3219 - protein, 7 aa, Artificial Sequence
  Description of Artificial Sequence: Synthetic peptide
DASYRAT

SEQ ID NO: 3220 - protein, 9 aa, Artificial Sequence
  Description of Artificial Sequence: Synthetic peptide
QQRGNWPIT

SEQ ID NO: 3221 - protein, 5 aa, Artificial Sequence
  Description of Artificial Sequence: Synthetic peptide
KYPMW

SEQ ID NO: 3222 - protein, 17 aa, Artificial Sequence
  Description of Artificial Sequence: Synthetic peptide
YISPSGGGTLYADSVKG

SEQ ID NO: 3223 - protein, 15 aa, Artificial Sequence
  Description of Artificial Sequence: Synthetic peptide
DRAYGDYVGWNGFDY

SEQ ID NO: 3224 - protein, 11 aa, Artificial Sequence
  Description of Artificial Sequence: Synthetic peptide
RASQSISSFLA

SEQ ID NO: 3225 - protein, 7 aa, Artificial Sequence
  Description of Artificial Sequence: Synthetic peptide
DASYRAT

SEQ ID NO: 3226 - protein, 9 aa, Artificial Sequence
  Description of Artificial Sequence: Synthetic peptide
QQRGNWPIT

SEQ ID NO: 3227 - protein, 5 aa, Artificial Sequence
  Description of Artificial Sequence: Synthetic peptide
KYPMW

SEQ ID NO: 3228 - protein, 17 aa, Artificial Sequence
  Description of Artificial Sequence: Synthetic peptide
YISPSGGGTYYADSVKG

SEQ ID NO: 3229 - protein, 15 aa, Artificial Sequence
  Description of Artificial Sequence: Synthetic peptide
DRAYGDYVGWNGFDY

SEQ ID NO: 3230 - protein, 11 aa, Artificial Sequence
  Description of Artificial Sequence: Synthetic peptide
RASQSISSFLA

SEQ ID NO: 3231 - protein, 7 aa, Artificial Sequence
  Description of Artificial Sequence: Synthetic peptide
DASYRAT

SEQ ID NO: 3232 - protein, 9 aa, Artificial Sequence
  Description of Artificial Sequence: Synthetic peptide
QQRGNWPIT

SEQ ID NO: 3233 - protein, 5 aa, Artificial Sequence
  Description of Artificial Sequence: Synthetic peptide
KYPMW

SEQ ID NO: 3234 - protein, 17 aa, Artificial Sequence
  Description of Artificial Sequence: Synthetic peptide
YISSSGGGTYYADSVKG

SEQ ID NO: 3235 - protein, 15 aa, Artificial Sequence
  Description of Artificial Sequence: Synthetic peptide
DRAYGDYVGWNGFDY

SEQ ID NO: 3236 - protein, 11 aa, Artificial Sequence
  Description of Artificial Sequence: Synthetic peptide
RASQSISSFLA

SEQ ID NO: 3237 - protein, 7 aa, Artificial Sequence
  Description of Artificial Sequence: Synthetic peptide
DASYRAT

SEQ ID NO: 3238 - protein, 9 aa, Artificial Sequence
  Description of Artificial Sequence: Synthetic peptide
QQRGNWPIT

SEQ ID NO: 3239 - protein, 5 aa, Artificial Sequence
  Description of Artificial Sequence: Synthetic peptide
KYPMW

SEQ ID NO: 3240 - protein, 17 aa, Artificial Sequence
  Description of Artificial Sequence: Synthetic peptide
YIVPSGGATFYADSVKG

SEQ ID NO: 3241 - protein, 15 aa, Artificial Sequence
  Description of Artificial Sequence: Synthetic peptide
DRAYGDYVGWNGFDY

SEQ ID NO: 3242 - protein, 11 aa, Artificial Sequence
  Description of Artificial Sequence: Synthetic peptide
RASQSISSFLA

SEQ ID NO: 3243 - protein, 7 aa, Artificial Sequence
  Description of Artificial Sequence: Synthetic peptide
DASYRAT

SEQ ID NO: 3244 - protein, 9 aa, Artificial Sequence
  Description of Artificial Sequence: Synthetic peptide
QQRGNWPIT

SEQ ID NO: 3245 - protein, 5 aa, Artificial Sequence
  Description of Artificial Sequence: Synthetic peptide
KYPMW

SEQ ID NO: 3246 - protein, 17 aa, Artificial Sequence
  Description of Artificial Sequence: Synthetic peptide
YIVPSGGPTWYADSVKG

SEQ ID NO: 3247 - protein, 15 aa, Artificial Sequence
  Description of Artificial Sequence: Synthetic peptide
DRAYGDYVGWNGFDY

SEQ ID NO: 3248 - protein, 11 aa, Artificial Sequence
  Description of Artificial Sequence: Synthetic peptide
RASQSISSFLA

SEQ ID NO: 3249 - protein, 7 aa, Artificial Sequence
  Description of Artificial Sequence: Synthetic peptide
DASYRAT

SEQ ID NO: 3250 - protein, 9 aa, Artificial Sequence
  Description of Artificial Sequence: Synthetic peptide
QQRGNWPIT

SEQ ID NO: 3251 - protein, 5 aa, Artificial Sequence
  Description of Artificial Sequence: Synthetic peptide
KYPMW

SEQ ID NO: 3252 - protein, 17 aa, Artificial Sequence
  Description of Artificial Sequence: Synthetic peptide
YIVPSGGWTAYADSVKG

SEQ ID NO: 3253 - protein, 15 aa, Artificial Sequence
  Description of Artificial Sequence: Synthetic peptide
DRAYGDYVGWNGFDY

SEQ ID NO: 3254 - protein, 11 aa, Artificial Sequence
  Description of Artificial Sequence: Synthetic peptide
RASQSISSFLA

SEQ ID NO: 3255 - protein, 7 aa, Artificial Sequence
  Description of Artificial Sequence: Synthetic peptide
DASYRAT

SEQ ID NO: 3256 - protein, 9 aa, Artificial Sequence
  Description of Artificial Sequence: Synthetic peptide
QQRGNWPIT

SEQ ID NO: 3257 - protein, 5 aa, Artificial Sequence
  Description of Artificial Sequence: Synthetic peptide
KYQMW

SEQ ID NO: 3258 - protein, 17 aa, Artificial Sequence
  Description of Artificial Sequence: Synthetic peptide
SIYPSGGATFYADSVKG

SEQ ID NO: 3259 - protein, 15 aa, Artificial Sequence
  Description of Artificial Sequence: Synthetic peptide
DRAYGDYVGWNGFDY

SEQ ID NO: 3260 - protein, 11 aa, Artificial Sequence
  Description of Artificial Sequence: Synthetic peptide
RASQSISSFLA

SEQ ID NO: 3261 - protein, 7 aa, Artificial Sequence
  Description of Artificial Sequence: Synthetic peptide
DASYRAT

SEQ ID NO: 3262 - protein, 9 aa, Artificial Sequence
  Description of Artificial Sequence: Synthetic peptide
QQRGNWPIT

SEQ ID NO: 3263 - protein, 5 aa, Artificial Sequence
  Description of Artificial Sequence: Synthetic peptide
KYQMW

SEQ ID NO: 3264 - protein, 17 aa, Artificial Sequence
  Description of Artificial Sequence: Synthetic peptide
SIYPSGGGTFYADSVKG

SEQ ID NO: 3265 - protein, 15 aa, Artificial Sequence
  Description of Artificial Sequence: Synthetic peptide
DRAYGDYVGWNGFDY

SEQ ID NO: 3266 - protein, 11 aa, Artificial Sequence
  Description of Artificial Sequence: Synthetic peptide
RASQSISSFLA

SEQ ID NO: 3267 - protein, 7 aa, Artificial Sequence
  Description of Artificial Sequence: Synthetic peptide
DASYRAT

SEQ ID NO: 3268 - protein, 9 aa, Artificial Sequence
  Description of Artificial Sequence: Synthetic peptide
QQRGNWPIT

SEQ ID NO: 3269 - protein, 5 aa, Artificial Sequence
  Description of Artificial Sequence: Synthetic peptide
KYSMI

SEQ ID NO: 3270 - protein, 17 aa, Artificial Sequence
  Description of Artificial Sequence: Synthetic peptide
YIVPSGGYTGYADSVKG

SEQ ID NO: 3271 - protein, 15 aa, Artificial Sequence
  Description of Artificial Sequence: Synthetic peptide
DRAYGDYVGWNGFDY

SEQ ID NO: 3272 - protein, 11 aa, Artificial Sequence
  Description of Artificial Sequence: Synthetic peptide
RASQSISSFLA

SEQ ID NO: 3273 - protein, 7 aa, Artificial Sequence
  Description of Artificial Sequence: Synthetic peptide
DASYRAT

SEQ ID NO: 3274 - protein, 9 aa, Artificial Sequence
  Description of Artificial Sequence: Synthetic peptide
QQRGNWPIT

SEQ ID NO: 3275 - protein, 5 aa, Artificial Sequence
  Description of Artificial Sequence: Synthetic peptide
KYSMW

SEQ ID NO: 3276 - protein, 17 aa, Artificial Sequence
  Description of Artificial Sequence: Synthetic peptide
SIYPSGGATFYADSVKG

SEQ ID NO: 3277 - protein, 15 aa, Artificial Sequence
  Description of Artificial Sequence: Synthetic peptide
DRAYGDYVGWNGFDY

SEQ ID NO: 3278 - protein, 11 aa, Artificial Sequence
  Description of Artificial Sequence: Synthetic peptide
RASQSISSFLA

SEQ ID NO: 3279 - protein, 7 aa, Artificial Sequence
  Description of Artificial Sequence: Synthetic peptide
DASYRAT

SEQ ID NO: 3280 - protein, 9 aa, Artificial Sequence
  Description of Artificial Sequence: Synthetic peptide
QQRGNWPIT

SEQ ID NO: 3281 - protein, 5 aa, Artificial Sequence
  Description of Artificial Sequence: Synthetic peptide
KYSMW

SEQ ID NO: 3282 - protein, 17 aa, Artificial Sequence
  Description of Artificial Sequence: Synthetic peptide
VIYPSGGATFYADSVKG

SEQ ID NO: 3283 - protein, 15 aa, Artificial Sequence
  Description of Artificial Sequence: Synthetic peptide
DRAYGDYVGWNGFDY

SEQ ID NO: 3284 - protein, 11 aa, Artificial Sequence
  Description of Artificial Sequence: Synthetic peptide
RASQSISSFLA

SEQ ID NO: 3285 - protein, 7 aa, Artificial Sequence
  Description of Artificial Sequence: Synthetic peptide
DASYRAT

SEQ ID NO: 3286 - protein, 9 aa, Artificial Sequence
  Description of Artificial Sequence: Synthetic peptide
QQRGNWPIT

SEQ ID NO: 3287 - protein, 5 aa, Artificial Sequence
  Description of Artificial Sequence: Synthetic peptide
KYSMW

SEQ ID NO: 3288 - protein, 17 aa, Artificial Sequence
  Description of Artificial Sequence: Synthetic peptide
VIYPSGGFTDYADSVKG

SEQ ID NO: 3289 - protein, 15 aa, Artificial Sequence
  Description of Artificial Sequence: Synthetic peptide
DRAYGDYVGWNGFDY

SEQ ID NO: 3290 - protein, 11 aa, Artificial Sequence
  Description of Artificial Sequence: Synthetic peptide
RASQSISSFLA

SEQ ID NO: 3291 - protein, 7 aa, Artificial Sequence
  Description of Artificial Sequence: Synthetic peptide
DASYRAT

SEQ ID NO: 3292 - protein, 9 aa, Artificial Sequence
  Description of Artificial Sequence: Synthetic peptide
QQRGNWPIT

SEQ ID NO: 3293 - protein, 5 aa, Artificial Sequence
  Description of Artificial Sequence: Synthetic peptide
KYTMW

SEQ ID NO: 3294 - protein, 17 aa, Artificial Sequence
  Description of Artificial Sequence: Synthetic peptide
VIYPSGGATFYADSVKG

SEQ ID NO: 3295 - protein, 15 aa, Artificial Sequence
  Description of Artificial Sequence: Synthetic peptide
DRAYGDYVGWNGFDY

SEQ ID NO: 3296 - protein, 11 aa, Artificial Sequence
  Description of Artificial Sequence: Synthetic peptide
RASQSISSFLA

SEQ ID NO: 3297 - protein, 7 aa, Artificial Sequence
  Description of Artificial Sequence: Synthetic peptide
DASYRAT

SEQ ID NO: 3298 - protein, 9 aa, Artificial Sequence
  Description of Artificial Sequence: Synthetic peptide
QQRGNWPIT

SEQ ID NO: 3299 - protein, 5 aa, Artificial Sequence
  Description of Artificial Sequence: Synthetic peptide
KYWMW

SEQ ID NO: 3300 - protein, 17 aa, Artificial Sequence
  Description of Artificial Sequence: Synthetic peptide
VIVPSGGMTYYADSVKG

SEQ ID NO: 3301 - protein, 15 aa, Artificial Sequence
  Description of Artificial Sequence: Synthetic peptide
DRAYGDYVGWNGFDY

SEQ ID NO: 3302 - protein, 11 aa, Artificial Sequence
  Description of Artificial Sequence: Synthetic peptide
RASQSISSFLA

SEQ ID NO: 3303 - protein, 7 aa, Artificial Sequence
  Description of Artificial Sequence: Synthetic peptide
DASYRAT

SEQ ID NO: 3304 - protein, 9 aa, Artificial Sequence
  Description of Artificial Sequence: Synthetic peptide
QQRGNWPIT

SEQ ID NO: 3305 - protein, 5 aa, Artificial Sequence
  Description of Artificial Sequence: Synthetic peptide
KYYMW

SEQ ID NO: 3306 - protein, 17 aa, Artificial Sequence
  Description of Artificial Sequence: Synthetic peptide
SIYSSGGGTFYADSVKG

SEQ ID NO: 3307 - protein, 15 aa, Artificial Sequence
  Description of Artificial Sequence: Synthetic peptide
DRAYGDYVGWNGFDY

SEQ ID NO: 3308 - protein, 11 aa, Artificial Sequence
  Description of Artificial Sequence: Synthetic peptide
RASQSISSFLA

SEQ ID NO: 3309 - protein, 7 aa, Artificial Sequence
  Description of Artificial Sequence: Synthetic peptide
DASYRAT

SEQ ID NO: 3310 - protein, 9 aa, Artificial Sequence
  Description of Artificial Sequence: Synthetic peptide
QQRGNWPIT

SEQ ID NO: 3311 - protein, 5 aa, Artificial Sequence
  Description of Artificial Sequence: Synthetic peptide
LYAMI

SEQ ID NO: 3312 - protein, 17 aa, Artificial Sequence
  Description of Artificial Sequence: Synthetic peptide
YISPSGGFTGYADSVKG

SEQ ID NO: 3313 - protein, 15 aa, Artificial Sequence
  Description of Artificial Sequence: Synthetic peptide
DRAYGDYVGWNGFDY

SEQ ID NO: 3314 - protein, 11 aa, Artificial Sequence
  Description of Artificial Sequence: Synthetic peptide
RASQSISSFLA

SEQ ID NO: 3315 - protein, 7 aa, Artificial Sequence
  Description of Artificial Sequence: Synthetic peptide
DASYRAT

SEQ ID NO: 3316 - protein, 9 aa, Artificial Sequence
  Description of Artificial Sequence: Synthetic peptide
QQRGNWPIT

SEQ ID NO: 3317 - protein, 5 aa, Artificial Sequence
  Description of Artificial Sequence: Synthetic peptide
LYAMW

SEQ ID NO: 3318 - protein, 17 aa, Artificial Sequence
  Description of Artificial Sequence: Synthetic peptide
SIVPSGGKTYYADSVKG

SEQ ID NO: 3319 - protein, 15 aa, Artificial Sequence
  Description of Artificial Sequence: Synthetic peptide
DRAYGDYVGWNGFDY

SEQ ID NO: 3320 - protein, 11 aa, Artificial Sequence
  Description of Artificial Sequence: Synthetic peptide
RASQSISSFLA

SEQ ID NO: 3321 - protein, 7 aa, Artificial Sequence
  Description of Artificial Sequence: Synthetic peptide
DASYRAT

SEQ ID NO: 3322 - protein, 9 aa, Artificial Sequence
  Description of Artificial Sequence: Synthetic peptide
QQRGNWPIT

SEQ ID NO: 3323 - protein, 5 aa, Artificial Sequence
  Description of Artificial Sequence: Synthetic peptide
LYAMW

SEQ ID NO: 3324 - protein, 17 aa, Artificial Sequence
  Description of Artificial Sequence: Synthetic peptide
YIYPSGGGTYYADSVKG

SEQ ID NO: 3325 - protein, 15 aa, Artificial Sequence
  Description of Artificial Sequence: Synthetic peptide
DRAYGDYVGWNGFDY

SEQ ID NO: 3326 - protein, 11 aa, Artificial Sequence
  Description of Artificial Sequence: Synthetic peptide
RASQSISSFLA

SEQ ID NO: 3327 - protein, 7 aa, Artificial Sequence
  Description of Artificial Sequence: Synthetic peptide
DASYRAT

SEQ ID NO: 3328 - protein, 9 aa, Artificial Sequence
  Description of Artificial Sequence: Synthetic peptide
QQRGNWPIT

SEQ ID NO: 3329 - protein, 5 aa, Artificial Sequence
  Description of Artificial Sequence: Synthetic peptide
LYDML

SEQ ID NO: 3330 - protein, 17 aa, Artificial Sequence
  Description of Artificial Sequence: Synthetic peptide
YIYPSGGFTGYADSVKG

SEQ ID NO: 3331 - protein, 15 aa, Artificial Sequence
  Description of Artificial Sequence: Synthetic peptide
DRAYGDYVGWNGFDY

SEQ ID NO: 3332 - protein, 11 aa, Artificial Sequence
  Description of Artificial Sequence: Synthetic peptide
RASQSISSFLA

SEQ ID NO: 3333 - protein, 7 aa, Artificial Sequence
  Description of Artificial Sequence: Synthetic peptide
DASYRAT

SEQ ID NO: 3334 - protein, 9 aa, Artificial Sequence
  Description of Artificial Sequence: Synthetic peptide
QQRGNWPIT

SEQ ID NO: 3335 - protein, 5 aa, Artificial Sequence
  Description of Artificial Sequence: Synthetic peptide
LYDMV

SEQ ID NO: 3336 - protein, 17 aa, Artificial Sequence
  Description of Artificial Sequence: Synthetic peptide
WIGPSGGLTIYADSVKG

SEQ ID NO: 3337 - protein, 15 aa, Artificial Sequence
  Description of Artificial Sequence: Synthetic peptide
DRAYGDYVGWNGFDY

SEQ ID NO: 3338 - protein, 11 aa, Artificial Sequence
  Description of Artificial Sequence: Synthetic peptide
RASQSISSFLA

SEQ ID NO: 3339 - protein, 7 aa, Artificial Sequence
  Description of Artificial Sequence: Synthetic peptide
DASYRAT

SEQ ID NO: 3340 - protein, 9 aa, Artificial Sequence
  Description of Artificial Sequence: Synthetic peptide
QQRGNWPIT

SEQ ID NO: 3341 - protein, 5 aa, Artificial Sequence
  Description of Artificial Sequence: Synthetic peptide
LYDMW

SEQ ID NO: 3342 - protein, 17 aa, Artificial Sequence
  Description of Artificial Sequence: Synthetic peptide
SISSSGGYTGYADSVKG

SEQ ID NO: 3343 - protein, 15 aa, Artificial Sequence
  Description of Artificial Sequence: Synthetic peptide
DRAYGDYVGWNGFDY

SEQ ID NO: 3344 - protein, 11 aa, Artificial Sequence
  Description of Artificial Sequence: Synthetic peptide
RASQSISSFLA

SEQ ID NO: 3345 - protein, 7 aa, Artificial Sequence
  Description of Artificial Sequence: Synthetic peptide
DASYRAT

SEQ ID NO: 3346 - protein, 9 aa, Artificial Sequence
  Description of Artificial Sequence: Synthetic peptide
QQRGNWPIT

SEQ ID NO: 3347 - protein, 5 aa, Artificial Sequence
  Description of Artificial Sequence: Synthetic peptide
LYDMW

SEQ ID NO: 3348 - protein, 17 aa, Artificial Sequence
  Description of Artificial Sequence: Synthetic peptide
VIRPSGGSTYYADSVKG

SEQ ID NO: 3349 - protein, 15 aa, Artificial Sequence
  Description of Artificial Sequence: Synthetic peptide
DRAYGDYVGWNGFDY

SEQ ID NO: 3350 - protein, 11 aa, Artificial Sequence
  Description of Artificial Sequence: Synthetic peptide
RASQSISSFLA

SEQ ID NO: 3351 - protein, 7 aa, Artificial Sequence
  Description of Artificial Sequence: Synthetic peptide
DASYRAT

SEQ ID NO: 3352 - protein, 9 aa, Artificial Sequence
  Description of Artificial Sequence: Synthetic peptide
QQRGNWPIT

SEQ ID NO: 3353 - protein, 5 aa, Artificial Sequence
  Description of Artificial Sequence: Synthetic peptide
LYDMW

SEQ ID NO: 3354 - protein, 17 aa, Artificial Sequence
  Description of Artificial Sequence: Synthetic peptide
VIYPSGGPTYYADSVKG

SEQ ID NO: 3355 - protein, 15 aa, Artificial Sequence
  Description of Artificial Sequence: Synthetic peptide
DRAYGDYVGWNGFDY

SEQ ID NO: 3356 - protein, 11 aa, Artificial Sequence
  Description of Artificial Sequence: Synthetic peptide
RASQSISSFLA

SEQ ID NO: 3357 - protein, 7 aa, Artificial Sequence
  Description of Artificial Sequence: Synthetic peptide
DASYRAT

SEQ ID NO: 3358 - protein, 9 aa, Artificial Sequence
  Description of Artificial Sequence: Synthetic peptide
QQRGNWPIT

SEQ ID NO: 3359 - protein, 5 aa, Artificial Sequence
  Description of Artificial Sequence: Synthetic peptide
LYDMW

SEQ ID NO: 3360 - protein, 17 aa, Artificial Sequence
  Description of Artificial Sequence: Synthetic peptide
VIYSSGGATFYADSVKG

SEQ ID NO: 3361 - protein, 15 aa, Artificial Sequence
  Description of Artificial Sequence: Synthetic peptide
DRAYGDYVGWNGFDY

SEQ ID NO: 3362 - protein, 11 aa, Artificial Sequence
  Description of Artificial Sequence: Synthetic peptide
RASQSISSFLA

SEQ ID NO: 3363 - protein, 7 aa, Artificial Sequence
  Description of Artificial Sequence: Synthetic peptide
DASYRAT

SEQ ID NO: 3364 - protein, 9 aa, Artificial Sequence
  Description of Artificial Sequence: Synthetic peptide
QQRGNWPIT

SEQ ID NO: 3365 - protein, 5 aa, Artificial Sequence
  Description of Artificial Sequence: Synthetic peptide
LYDMW

SEQ ID NO: 3366 - protein, 17 aa, Artificial Sequence
  Description of Artificial Sequence: Synthetic peptide
VIYSSGGTTFYADSVKG

SEQ ID NO: 3367 - protein, 15 aa, Artificial Sequence
  Description of Artificial Sequence: Synthetic peptide
DRAYGDYVGWNGFDY

SEQ ID NO: 3368 - protein, 11 aa, Artificial Sequence
  Description of Artificial Sequence: Synthetic peptide
RASQSISSFLA

SEQ ID NO: 3369 - protein, 7 aa, Artificial Sequence
  Description of Artificial Sequence: Synthetic peptide
DASYRAT

SEQ ID NO: 3370 - protein, 9 aa, Artificial Sequence
  Description of Artificial Sequence: Synthetic peptide
QQRGNWPIT

SEQ ID NO: 3371 - protein, 5 aa, Artificial Sequence
  Description of Artificial Sequence: Synthetic peptide
LYDMW

SEQ ID NO: 3372 - protein, 17 aa, Artificial Sequence
  Description of Artificial Sequence: Synthetic peptide
VIYSSGGYTAYADSVKG

SEQ ID NO: 3373 - protein, 15 aa, Artificial Sequence
  Description of Artificial Sequence: Synthetic peptide
DRAYGDYVGWNGFDY

SEQ ID NO: 3374 - protein, 11 aa, Artificial Sequence
  Description of Artificial Sequence: Synthetic peptide
RASQSISSFLA

SEQ ID NO: 3375 - protein, 7 aa, Artificial Sequence
  Description of Artificial Sequence: Synthetic peptide
DASYRAT

SEQ ID NO: 3376 - protein, 9 aa, Artificial Sequence
  Description of Artificial Sequence: Synthetic peptide
QQRGNWPIT

SEQ ID NO: 3377 - protein, 5 aa, Artificial Sequence
  Description of Artificial Sequence: Synthetic peptide
LYDMW

SEQ ID NO: 3378 - protein, 17 aa, Artificial Sequence
  Description of Artificial Sequence: Synthetic peptide
VIYSSGGYTGYADSVKG

SEQ ID NO: 3379 - protein, 15 aa, Artificial Sequence
  Description of Artificial Sequence: Synthetic peptide
DRAYGDYVGWNGFDY

SEQ ID NO: 3380 - protein, 11 aa, Artificial Sequence
  Description of Artificial Sequence: Synthetic peptide
RASQSISSFLA

SEQ ID NO: 3381 - protein, 7 aa, Artificial Sequence
  Description of Artificial Sequence: Synthetic peptide
DASYRAT

SEQ ID NO: 3382 - protein, 9 aa, Artificial Sequence
  Description of Artificial Sequence: Synthetic peptide
QQRGNWPIT

SEQ ID NO: 3383 - protein, 5 aa, Artificial Sequence
  Description of Artificial Sequence: Synthetic peptide
LYDMW

SEQ ID NO: 3384 - protein, 17 aa, Artificial Sequence
  Description of Artificial Sequence: Synthetic peptide
YIGPSGGNTLYADSVKG

SEQ ID NO: 3385 - protein, 15 aa, Artificial Sequence
  Description of Artificial Sequence: Synthetic peptide
DRAYGDYVGWNGFDY

SEQ ID NO: 3386 - protein, 11 aa, Artificial Sequence
  Description of Artificial Sequence: Synthetic peptide
RASQSISSFLA

SEQ ID NO: 3387 - protein, 7 aa, Artificial Sequence
  Description of Artificial Sequence: Synthetic peptide
DASYRAT

SEQ ID NO: 3388 - protein, 9 aa, Artificial Sequence
  Description of Artificial Sequence: Synthetic peptide
QQRGNWPIT

SEQ ID NO: 3389 - protein, 5 aa, Artificial Sequence
  Description of Artificial Sequence: Synthetic peptide
LYEMW

SEQ ID NO: 3390 - protein, 17 aa, Artificial Sequence
  Description of Artificial Sequence: Synthetic peptide
VISPSGGGTYYADSVKG

SEQ ID NO: 3391 - protein, 15 aa, Artificial Sequence
  Description of Artificial Sequence: Synthetic peptide
DRAYGDYVGWNGFDY

SEQ ID NO: 3392 - protein, 11 aa, Artificial Sequence
  Description of Artificial Sequence: Synthetic peptide
RASQSISSFLA

SEQ ID NO: 3393 - protein, 7 aa, Artificial Sequence
  Description of Artificial Sequence: Synthetic peptide
DASYRAT

SEQ ID NO: 3394 - protein, 9 aa, Artificial Sequence
  Description of Artificial Sequence: Synthetic peptide
QQRGNWPIT

SEQ ID NO: 3395 - protein, 5 aa, Artificial Sequence
  Description of Artificial Sequence: Synthetic peptide
LYEMW

SEQ ID NO: 3396 - protein, 17 aa, Artificial Sequence
  Description of Artificial Sequence: Synthetic peptide
YISSSGGGTLYADSVKG

SEQ ID NO: 3397 - protein, 15 aa, Artificial Sequence
  Description of Artificial Sequence: Synthetic peptide
DRAYGDYVGWNGFDY

SEQ ID NO: 3398 - protein, 11 aa, Artificial Sequence
  Description of Artificial Sequence: Synthetic peptide
RASQSISSFLA

SEQ ID NO: 3399 - protein, 7 aa, Artificial Sequence
  Description of Artificial Sequence: Synthetic peptide
DASYRAT

SEQ ID NO: 3400 - protein, 9 aa, Artificial Sequence
  Description of Artificial Sequence: Synthetic peptide
QQRGNWPIT

SEQ ID NO: 3401 - protein, 5 aa, Artificial Sequence
  Description of Artificial Sequence: Synthetic peptide
LYMMW

SEQ ID NO: 3402 - protein, 16 aa, Artificial Sequence
  Description of Artificial Sequence: Synthetic peptide
SIYPSGGTYYADSVKG

SEQ ID NO: 3403 - protein, 15 aa, Artificial Sequence
  Description of Artificial Sequence: Synthetic peptide
DRAYGDYVGWNGFDY

SEQ ID NO: 3404 - protein, 11 aa, Artificial Sequence
  Description of Artificial Sequence: Synthetic peptide
RASQSISSFLA

SEQ ID NO: 3405 - protein, 7 aa, Artificial Sequence
  Description of Artificial Sequence: Synthetic peptide
DASYRAT

SEQ ID NO: 3406 - protein, 9 aa, Artificial Sequence
  Description of Artificial Sequence: Synthetic peptide
QQRGNWPIT

SEQ ID NO: 3407 - protein, 5 aa, Artificial Sequence
  Description of Artificial Sequence: Synthetic peptide
LYNMW

SEQ ID NO: 3408 - protein, 17 aa, Artificial Sequence
  Description of Artificial Sequence: Synthetic peptide
VIYPSGGYTGYADSVKG

SEQ ID NO: 3409 - protein, 15 aa, Artificial Sequence
  Description of Artificial Sequence: Synthetic peptide
DRAYGDYVGWNGFDY

SEQ ID NO: 3410 - protein, 11 aa, Artificial Sequence
  Description of Artificial Sequence: Synthetic peptide
RASQSISSFLA

SEQ ID NO: 3411 - protein, 7 aa, Artificial Sequence
  Description of Artificial Sequence: Synthetic peptide
DASYRAT

SEQ ID NO: 3412 - protein, 9 aa, Artificial Sequence
  Description of Artificial Sequence: Synthetic peptide
QQRGNWPIT

SEQ ID NO: 3413 - protein, 5 aa, Artificial Sequence
  Description of Artificial Sequence: Synthetic peptide
LYPMI

SEQ ID NO: 3414 - protein, 17 aa, Artificial Sequence
  Description of Artificial Sequence: Synthetic peptide
YISPSGGFTDYADSVKG

SEQ ID NO: 3415 - protein, 15 aa, Artificial Sequence
  Description of Artificial Sequence: Synthetic peptide
DRAYGDYVGWNGFDY

SEQ ID NO: 3416 - protein, 11 aa, Artificial Sequence
  Description of Artificial Sequence: Synthetic peptide
RASQSISSFLA

SEQ ID NO: 3417 - protein, 7 aa, Artificial Sequence
  Description of Artificial Sequence: Synthetic peptide
DASYRAT

SEQ ID NO: 3418 - protein, 9 aa, Artificial Sequence
  Description of Artificial Sequence: Synthetic peptide
QQRGNWPIT

SEQ ID NO: 3419 - protein, 5 aa, Artificial Sequence
  Description of Artificial Sequence: Synthetic peptide
LYPMM

SEQ ID NO: 3420 - protein, 17 aa, Artificial Sequence
  Description of Artificial Sequence: Synthetic peptide
YIYPSGGGTFYADSVKG

SEQ ID NO: 3421 - protein, 15 aa, Artificial Sequence
  Description of Artificial Sequence: Synthetic peptide
DRAYGDYVGWNGFDY

SEQ ID NO: 3422 - protein, 11 aa, Artificial Sequence
  Description of Artificial Sequence: Synthetic peptide
RASQSISSFLA

SEQ ID NO: 3423 - protein, 7 aa, Artificial Sequence
  Description of Artificial Sequence: Synthetic peptide
DASYRAT

SEQ ID NO: 3424 - protein, 9 aa, Artificial Sequence
  Description of Artificial Sequence: Synthetic peptide
QQRGNWPIT

SEQ ID NO: 3425 - protein, 5 aa, Artificial Sequence
  Description of Artificial Sequence: Synthetic peptide
LYPMW

SEQ ID NO: 3426 - protein, 17 aa, Artificial Sequence
  Description of Artificial Sequence: Synthetic peptide
SISPSGGATFYADSVKG

SEQ ID NO: 3427 - protein, 15 aa, Artificial Sequence
  Description of Artificial Sequence: Synthetic peptide
DRAYGDYVGWNGFDY

SEQ ID NO: 3428 - protein, 11 aa, Artificial Sequence
  Description of Artificial Sequence: Synthetic peptide
RASQSISSFLA

SEQ ID NO: 3429 - protein, 7 aa, Artificial Sequence
  Description of Artificial Sequence: Synthetic peptide
DASYRAT

SEQ ID NO: 3430 - protein, 9 aa, Artificial Sequence
  Description of Artificial Sequence: Synthetic peptide
QQRGNWPIT

SEQ ID NO: 3431 - protein, 5 aa, Artificial Sequence
  Description of Artificial Sequence: Synthetic peptide
LYPMW

SEQ ID NO: 3432 - protein, 17 aa, Artificial Sequence
  Description of Artificial Sequence: Synthetic peptide
SISPSGGGTFYADSVKG

SEQ ID NO: 3433 - protein, 15 aa, Artificial Sequence
  Description of Artificial Sequence: Synthetic peptide
DRAYGDYVGWNGFDY

SEQ ID NO: 3434 - protein, 11 aa, Artificial Sequence
  Description of Artificial Sequence: Synthetic peptide
RASQSISSFLA

SEQ ID NO: 3435 - protein, 7 aa, Artificial Sequence
  Description of Artificial Sequence: Synthetic peptide
DASYRAT

SEQ ID NO: 3436 - protein, 9 aa, Artificial Sequence
  Description of Artificial Sequence: Synthetic peptide
QQRGNWPIT

SEQ ID NO: 3437 - protein, 5 aa, Artificial Sequence
  Description of Artificial Sequence: Synthetic peptide
LYPMW

SEQ ID NO: 3438 - protein, 17 aa, Artificial Sequence
  Description of Artificial Sequence: Synthetic peptide
SIYPSGGATFYADSVKG

SEQ ID NO: 3439 - protein, 15 aa, Artificial Sequence
  Description of Artificial Sequence: Synthetic peptide
DRAYGDYVGWNGFDY

SEQ ID NO: 3440 - protein, 11 aa, Artificial Sequence
  Description of Artificial Sequence: Synthetic peptide
RASQSISSFLA

SEQ ID NO: 3441 - protein, 7 aa, Artificial Sequence
  Description of Artificial Sequence: Synthetic peptide
DASYRAT

SEQ ID NO: 3442 - protein, 9 aa, Artificial Sequence
  Description of Artificial Sequence: Synthetic peptide
QQRGNWPIT

SEQ ID NO: 3443 - protein, 5 aa, Artificial Sequence
  Description of Artificial Sequence: Synthetic peptide
LYPMW

SEQ ID NO: 3444 - protein, 17 aa, Artificial Sequence
  Description of Artificial Sequence: Synthetic peptide
VIYSSGGATFYADSVKG

SEQ ID NO: 3445 - protein, 15 aa, Artificial Sequence
  Description of Artificial Sequence: Synthetic peptide
DRAYGDYVGWNGFDY

SEQ ID NO: 3446 - protein, 11 aa, Artificial Sequence
  Description of Artificial Sequence: Synthetic peptide
RASQSISSFLA

SEQ ID NO: 3447 - protein, 7 aa, Artificial Sequence
  Description of Artificial Sequence: Synthetic peptide
DASYRAT

SEQ ID NO: 3448 - protein, 9 aa, Artificial Sequence
  Description of Artificial Sequence: Synthetic peptide
QQRGNWPIT

SEQ ID NO: 3449 - protein, 5 aa, Artificial Sequence
  Description of Artificial Sequence: Synthetic peptide
LYPMW

SEQ ID NO: 3450 - protein, 17 aa, Artificial Sequence
  Description of Artificial Sequence: Synthetic peptide
WIVPSGGFTLYADSVKG

SEQ ID NO: 3451 - protein, 15 aa, Artificial Sequence
  Description of Artificial Sequence: Synthetic peptide
DRAYGDYVGWNGFDY

SEQ ID NO: 3452 - protein, 11 aa, Artificial Sequence
  Description of Artificial Sequence: Synthetic peptide
RASQSISSFLA

SEQ ID NO: 3453 - protein, 7 aa, Artificial Sequence
  Description of Artificial Sequence: Synthetic peptide
DASYRAT

SEQ ID NO: 3454 - protein, 9 aa, Artificial Sequence
  Description of Artificial Sequence: Synthetic peptide
QQRGNWPIT

SEQ ID NO: 3455 - protein, 5 aa, Artificial Sequence
  Description of Artificial Sequence: Synthetic peptide
LYPMW

SEQ ID NO: 3456 - protein, 17 aa, Artificial Sequence
  Description of Artificial Sequence: Synthetic peptide
YISPSGGGTLYADSVKG

SEQ ID NO: 3457 - protein, 15 aa, Artificial Sequence
  Description of Artificial Sequence: Synthetic peptide
DRAYGDYVGWNGFDY

SEQ ID NO: 3458 - protein, 11 aa, Artificial Sequence
  Description of Artificial Sequence: Synthetic peptide
RASQSISSFLA

SEQ ID NO: 3459 - protein, 7 aa, Artificial Sequence
  Description of Artificial Sequence: Synthetic peptide
DASYRAT

SEQ ID NO: 3460 - protein, 9 aa, Artificial Sequence
  Description of Artificial Sequence: Synthetic peptide
QQRGNWPIT

SEQ ID NO: 3461 - protein, 5 aa, Artificial Sequence
  Description of Artificial Sequence: Synthetic peptide
LYPMW

SEQ ID NO: 3462 - protein, 17 aa, Artificial Sequence
  Description of Artificial Sequence: Synthetic peptide
YISSSGGGTYYADSVKG

SEQ ID NO: 3463 - protein, 15 aa, Artificial Sequence
  Description of Artificial Sequence: Synthetic peptide
DRAYGDYVGWNGFDY

SEQ ID NO: 3464 - protein, 11 aa, Artificial Sequence
  Description of Artificial Sequence: Synthetic peptide
RASQSISSFLA

SEQ ID NO: 3465 - protein, 7 aa, Artificial Sequence
  Description of Artificial Sequence: Synthetic peptide
DASYRAT

SEQ ID NO: 3466 - protein, 9 aa, Artificial Sequence
  Description of Artificial Sequence: Synthetic peptide
QQRGNWPIT

SEQ ID NO: 3467 - protein, 5 aa, Artificial Sequence
  Description of Artificial Sequence: Synthetic peptide
LYPMW

SEQ ID NO: 3468 - protein, 17 aa, Artificial Sequence
  Description of Artificial Sequence: Synthetic peptide
YIVPSGGGTFYADSVKG

SEQ ID NO: 3469 - protein, 15 aa, Artificial Sequence
  Description of Artificial Sequence: Synthetic peptide
DRAYGDYVGWNGFDY

SEQ ID NO: 3470 - protein, 11 aa, Artificial Sequence
  Description of Artificial Sequence: Synthetic peptide
RASQSISSFLA

SEQ ID NO: 3471 - protein, 7 aa, Artificial Sequence
  Description of Artificial Sequence: Synthetic peptide
DASYRAT

SEQ ID NO: 3472 - protein, 9 aa, Artificial Sequence
  Description of Artificial Sequence: Synthetic peptide
QQRGNWPIT

SEQ ID NO: 3473 - protein, 5 aa, Artificial Sequence
  Description of Artificial Sequence: Synthetic peptide
LYPMW

SEQ ID NO: 3474 - protein, 17 aa, Artificial Sequence
  Description of Artificial Sequence: Synthetic peptide
YIVSSGGATFYADSVKG

SEQ ID NO: 3475 - protein, 15 aa, Artificial Sequence
  Description of Artificial Sequence: Synthetic peptide
DRAYGDYVGWNGFDY

SEQ ID NO: 3476 - protein, 11 aa, Artificial Sequence
  Description of Artificial Sequence: Synthetic peptide
RASQSISSFLA

SEQ ID NO: 3477 - protein, 7 aa, Artificial Sequence
  Description of Artificial Sequence: Synthetic peptide
DASYRAT

SEQ ID NO: 3478 - protein, 9 aa, Artificial Sequence
  Description of Artificial Sequence: Synthetic peptide
QQRGNWPIT

SEQ ID NO: 3479 - protein, 5 aa, Artificial Sequence
  Description of Artificial Sequence: Synthetic peptide
LYPMW

SEQ ID NO: 3480 - protein, 17 aa, Artificial Sequence
  Description of Artificial Sequence: Synthetic peptide
YIYPSGGATMYADSVKG

SEQ ID NO: 3481 - protein, 15 aa, Artificial Sequence
  Description of Artificial Sequence: Synthetic peptide
DRAYGDYVGWNGFDY

SEQ ID NO: 3482 - protein, 11 aa, Artificial Sequence
  Description of Artificial Sequence: Synthetic peptide
RASQSISSFLA

SEQ ID NO: 3483 - protein, 7 aa, Artificial Sequence
  Description of Artificial Sequence: Synthetic peptide
DASYRAT

SEQ ID NO: 3484 - protein, 9 aa, Artificial Sequence
  Description of Artificial Sequence: Synthetic peptide
QQRGNWPIT

SEQ ID NO: 3485 - protein, 5 aa, Artificial Sequence
  Description of Artificial Sequence: Synthetic peptide
LYQMW

SEQ ID NO: 3486 - protein, 17 aa, Artificial Sequence
  Description of Artificial Sequence: Synthetic peptide
VIYPSGGATYYADSVKG

SEQ ID NO: 3487 - protein, 15 aa, Artificial Sequence
  Description of Artificial Sequence: Synthetic peptide
DRAYGDYVGWNGFDY

SEQ ID NO: 3488 - protein, 11 aa, Artificial Sequence
  Description of Artificial Sequence: Synthetic peptide
RASQSISSFLA

SEQ ID NO: 3489 - protein, 7 aa, Artificial Sequence
  Description of Artificial Sequence: Synthetic peptide
DASYRAT

SEQ ID NO: 3490 - protein, 9 aa, Artificial Sequence
  Description of Artificial Sequence: Synthetic peptide
QQRGNWPIT

SEQ ID NO: 3491 - protein, 5 aa, Artificial Sequence
  Description of Artificial Sequence: Synthetic peptide
LYQMW

SEQ ID NO: 3492 - protein, 16 aa, Artificial Sequence
  Description of Artificial Sequence: Synthetic peptide
VIYPSGGTFYADSVKG

SEQ ID NO: 3493 - protein, 15 aa, Artificial Sequence
  Description of Artificial Sequence: Synthetic peptide
DRAYGDYVGWNGFDY

SEQ ID NO: 3494 - protein, 11 aa, Artificial Sequence
  Description of Artificial Sequence: Synthetic peptide
RASQSISSFLA

SEQ ID NO: 3495 - protein, 7 aa, Artificial Sequence
  Description of Artificial Sequence: Synthetic peptide
DASYRAT

SEQ ID NO: 3496 - protein, 9 aa, Artificial Sequence
  Description of Artificial Sequence: Synthetic peptide
QQRGNWPIT

SEQ ID NO: 3497 - protein, 5 aa, Artificial Sequence
  Description of Artificial Sequence: Synthetic peptide
MYDMW

SEQ ID NO: 3498 - protein, 17 aa, Artificial Sequence
  Description of Artificial Sequence: Synthetic peptide
VISPSGGGTFYADSVKG

SEQ ID NO: 3499 - protein, 15 aa, Artificial Sequence
  Description of Artificial Sequence: Synthetic peptide
DRAYGDYVGWNGFDY

SEQ ID NO: 3500 - protein, 11 aa, Artificial Sequence
  Description of Artificial Sequence: Synthetic peptide
RASQSISSFLA

SEQ ID NO: 3501 - protein, 7 aa, Artificial Sequence
  Description of Artificial Sequence: Synthetic peptide
DASYRAT

SEQ ID NO: 3502 - protein, 9 aa, Artificial Sequence
  Description of Artificial Sequence: Synthetic peptide
QQRGNWPIT

SEQ ID NO: 3503 - protein, 5 aa, Artificial Sequence
  Description of Artificial Sequence: Synthetic peptide
MYDMW

SEQ ID NO: 3504 - protein, 17 aa, Artificial Sequence
  Description of Artificial Sequence: Synthetic peptide
VIYPSGGNTLYADSVKG

SEQ ID NO: 3505 - protein, 15 aa, Artificial Sequence
  Description of Artificial Sequence: Synthetic peptide
DRAYGDYVGWNGFDY

SEQ ID NO: 3506 - protein, 11 aa, Artificial Sequence
  Description of Artificial Sequence: Synthetic peptide
RASQSISSFLA

SEQ ID NO: 3507 - protein, 7 aa, Artificial Sequence
  Description of Artificial Sequence: Synthetic peptide
DASYRAT

SEQ ID NO: 3508 - protein, 9 aa, Artificial Sequence
  Description of Artificial Sequence: Synthetic peptide
QQRGNWPIT

SEQ ID NO: 3509 - protein, 5 aa, Artificial Sequence
  Description of Artificial Sequence: Synthetic peptide
MYDMW

SEQ ID NO: 3510 - protein, 17 aa, Artificial Sequence
  Description of Artificial Sequence: Synthetic peptide
VIYPSGGPTFYADSVKG

SEQ ID NO: 3511 - protein, 15 aa, Artificial Sequence
  Description of Artificial Sequence: Synthetic peptide
DRAYGDYVGWNGFDY

SEQ ID NO: 3512 - protein, 11 aa, Artificial Sequence
  Description of Artificial Sequence: Synthetic peptide
RASQSISSFLA

SEQ ID NO: 3513 - protein, 7 aa, Artificial Sequence
  Description of Artificial Sequence: Synthetic peptide
DASYRAT

SEQ ID NO: 3514 - protein, 9 aa, Artificial Sequence
  Description of Artificial Sequence: Synthetic peptide
QQRGNWPIT

SEQ ID NO: 3515 - protein, 5 aa, Artificial Sequence
  Description of Artificial Sequence: Synthetic peptide
MYDMW

SEQ ID NO: 3516 - protein, 17 aa, Artificial Sequence
  Description of Artificial Sequence: Synthetic peptide
VIYPSGGYTAYADSVKG

SEQ ID NO: 3517 - protein, 15 aa, Artificial Sequence
  Description of Artificial Sequence: Synthetic peptide
DRAYGDYVGWNGFDY

SEQ ID NO: 3518 - protein, 11 aa, Artificial Sequence
  Description of Artificial Sequence: Synthetic peptide
RASQSISSFLA

SEQ ID NO: 3519 - protein, 7 aa, Artificial Sequence
  Description of Artificial Sequence: Synthetic peptide
DASYRAT

SEQ ID NO: 3520 - protein, 9 aa, Artificial Sequence
  Description of Artificial Sequence: Synthetic peptide
QQRGNWPIT

SEQ ID NO: 3521 - protein, 5 aa, Artificial Sequence
  Description of Artificial Sequence: Synthetic peptide
MYDMW

SEQ ID NO: 3522 - protein, 17 aa, Artificial Sequence
  Description of Artificial Sequence: Synthetic peptide
VIYSSGGFTDYADSVKG

SEQ ID NO: 3523 - protein, 15 aa, Artificial Sequence
  Description of Artificial Sequence: Synthetic peptide
DRAYGDYVGWNGFDY

SEQ ID NO: 3524 - protein, 11 aa, Artificial Sequence
  Description of Artificial Sequence: Synthetic peptide
RASQSISSFLA

SEQ ID NO: 3525 - protein, 7 aa, Artificial Sequence
  Description of Artificial Sequence: Synthetic peptide
DASYRAT

SEQ ID NO: 3526 - protein, 9 aa, Artificial Sequence
  Description of Artificial Sequence: Synthetic peptide
QQRGNWPIT

SEQ ID NO: 3527 - protein, 5 aa, Artificial Sequence
  Description of Artificial Sequence: Synthetic peptide
MYDMW

SEQ ID NO: 3528 - protein, 17 aa, Artificial Sequence
  Description of Artificial Sequence: Synthetic peptide
VIYSSGGPTFYADSVKG

SEQ ID NO: 3529 - protein, 15 aa, Artificial Sequence
  Description of Artificial Sequence: Synthetic peptide
DRAYGDYVGWNGFDY

SEQ ID NO: 3530 - protein, 11 aa, Artificial Sequence
  Description of Artificial Sequence: Synthetic peptide
RASQSISSFLA

SEQ ID NO: 3531 - protein, 7 aa, Artificial Sequence
  Description of Artificial Sequence: Synthetic peptide
DASYRAT

SEQ ID NO: 3532 - protein, 9 aa, Artificial Sequence
  Description of Artificial Sequence: Synthetic peptide
QQRGNWPIT

SEQ ID NO: 3533 - protein, 5 aa, Artificial Sequence
  Description of Artificial Sequence: Synthetic peptide
MYDMW

SEQ ID NO: 3534 - protein, 17 aa, Artificial Sequence
  Description of Artificial Sequence: Synthetic peptide
VIYSSGGVTFYADSVKG

SEQ ID NO: 3535 - protein, 15 aa, Artificial Sequence
  Description of Artificial Sequence: Synthetic peptide
DRAYGDYVGWNGFDY

SEQ ID NO: 3536 - protein, 11 aa, Artificial Sequence
  Description of Artificial Sequence: Synthetic peptide
RASQSISSFLA

SEQ ID NO: 3537 - protein, 7 aa, Artificial Sequence
  Description of Artificial Sequence: Synthetic peptide
DASYRAT

SEQ ID NO: 3538 - protein, 9 aa, Artificial Sequence
  Description of Artificial Sequence: Synthetic peptide
QQRGNWPIT

SEQ ID NO: 3539 - protein, 5 aa, Artificial Sequence
  Description of Artificial Sequence: Synthetic peptide
MYDMW

SEQ ID NO: 3540 - protein, 17 aa, Artificial Sequence
  Description of Artificial Sequence: Synthetic peptide
VIYSSGGYTAYADSVKG

SEQ ID NO: 3541 - protein, 15 aa, Artificial Sequence
  Description of Artificial Sequence: Synthetic peptide
DRAYGDYVGWNGFDY

SEQ ID NO: 3542 - protein, 11 aa, Artificial Sequence
  Description of Artificial Sequence: Synthetic peptide
RASQSISSFLA

SEQ ID NO: 3543 - protein, 7 aa, Artificial Sequence
  Description of Artificial Sequence: Synthetic peptide
DASYRAT

SEQ ID NO: 3544 - protein, 9 aa, Artificial Sequence
  Description of Artificial Sequence: Synthetic peptide
QQRGNWPIT

SEQ ID NO: 3545 - protein, 5 aa, Artificial Sequence
  Description of Artificial Sequence: Synthetic peptide
MYDMW

SEQ ID NO: 3546 - protein, 17 aa, Artificial Sequence
  Description of Artificial Sequence: Synthetic peptide
VIYSSGGYTDYADSVKG

SEQ ID NO: 3547 - protein, 15 aa, Artificial Sequence
  Description of Artificial Sequence: Synthetic peptide
DRAYGDYVGWNGFDY

SEQ ID NO: 3548 - protein, 11 aa, Artificial Sequence
  Description of Artificial Sequence: Synthetic peptide
RASQSISSFLA

SEQ ID NO: 3549 - protein, 7 aa, Artificial Sequence
  Description of Artificial Sequence: Synthetic peptide
DASYRAT

SEQ ID NO: 3550 - protein, 9 aa, Artificial Sequence
  Description of Artificial Sequence: Synthetic peptide
QQRGNWPIT

SEQ ID NO: 3551 - protein, 5 aa, Artificial Sequence
  Description of Artificial Sequence: Synthetic peptide
MYDMW

SEQ ID NO: 3552 - protein, 17 aa, Artificial Sequence
  Description of Artificial Sequence: Synthetic peptide
VIYSSGGYTNYADSVKG

SEQ ID NO: 3553 - protein, 15 aa, Artificial Sequence
  Description of Artificial Sequence: Synthetic peptide
DRAYGDYVGWNGFDY

SEQ ID NO: 3554 - protein, 11 aa, Artificial Sequence
  Description of Artificial Sequence: Synthetic peptide
RASQSISSFLA

SEQ ID NO: 3555 - protein, 7 aa, Artificial Sequence
  Description of Artificial Sequence: Synthetic peptide
DASYRAT

SEQ ID NO: 3556 - protein, 9 aa, Artificial Sequence
  Description of Artificial Sequence: Synthetic peptide
QQRGNWPIT

SEQ ID NO: 3557 - protein, 5 aa, Artificial Sequence
  Description of Artificial Sequence: Synthetic peptide
MYDMW

SEQ ID NO: 3558 - protein, 17 aa, Artificial Sequence
  Description of Artificial Sequence: Synthetic peptide
VIYSSGGYTSYADSVKG

SEQ ID NO: 3559 - protein, 15 aa, Artificial Sequence
  Description of Artificial Sequence: Synthetic peptide
DRAYGDYVGWNGFDY

SEQ ID NO: 3560 - protein, 11 aa, Artificial Sequence
  Description of Artificial Sequence: Synthetic peptide
RASQSISSFLA

SEQ ID NO: 3561 - protein, 7 aa, Artificial Sequence
  Description of Artificial Sequence: Synthetic peptide
DASYRAT

SEQ ID NO: 3562 - protein, 9 aa, Artificial Sequence
  Description of Artificial Sequence: Synthetic peptide
QQRGNWPIT

SEQ ID NO: 3563 - protein, 5 aa, Artificial Sequence
  Description of Artificial Sequence: Synthetic peptide
MYDMW

SEQ ID NO: 3564 - protein, 17 aa, Artificial Sequence
  Description of Artificial Sequence: Synthetic peptide
YISSSGGSTLYADSVKG

SEQ ID NO: 3565 - protein, 15 aa, Artificial Sequence
  Description of Artificial Sequence: Synthetic peptide
DRAYGDYVGWNGFDY

SEQ ID NO: 3566 - protein, 11 aa, Artificial Sequence
  Description of Artificial Sequence: Synthetic peptide
RASQSISSFLA

SEQ ID NO: 3567 - protein, 7 aa, Artificial Sequence
  Description of Artificial Sequence: Synthetic peptide
DASYRAT

SEQ ID NO: 3568 - protein, 9 aa, Artificial Sequence
  Description of Artificial Sequence: Synthetic peptide
QQRGNWPIT

SEQ ID NO: 3569 - protein, 5 aa, Artificial Sequence
  Description of Artificial Sequence: Synthetic peptide
MYMMI

SEQ ID NO: 3570 - protein, 17 aa, Artificial Sequence
  Description of Artificial Sequence: Synthetic peptide
SIYPSGGFTSYADSVKG

SEQ ID NO: 3571 - protein, 15 aa, Artificial Sequence
  Description of Artificial Sequence: Synthetic peptide
DRAYGDYVGWNGFDY

SEQ ID NO: 3572 - protein, 11 aa, Artificial Sequence
  Description of Artificial Sequence: Synthetic peptide
RASQSISSFLA

SEQ ID NO: 3573 - protein, 7 aa, Artificial Sequence
  Description of Artificial Sequence: Synthetic peptide
DASYRAT

SEQ ID NO: 3574 - protein, 9 aa, Artificial Sequence
  Description of Artificial Sequence: Synthetic peptide
QQRGNWPIT

SEQ ID NO: 3575 - protein, 5 aa, Artificial Sequence
  Description of Artificial Sequence: Synthetic peptide
MYNMW

SEQ ID NO: 3576 - protein, 17 aa, Artificial Sequence
  Description of Artificial Sequence: Synthetic peptide
SISPSGGATYYADSVKG

SEQ ID NO: 3577 - protein, 15 aa, Artificial Sequence
  Description of Artificial Sequence: Synthetic peptide
DRAYGDYVGWNGFDY

SEQ ID NO: 3578 - protein, 11 aa, Artificial Sequence
  Description of Artificial Sequence: Synthetic peptide
RASQSISSFLA

SEQ ID NO: 3579 - protein, 7 aa, Artificial Sequence
  Description of Artificial Sequence: Synthetic peptide
DASYRAT

SEQ ID NO: 3580 - protein, 9 aa, Artificial Sequence
  Description of Artificial Sequence: Synthetic peptide
QQRGNWPIT

SEQ ID NO: 3581 - protein, 5 aa, Artificial Sequence
  Description of Artificial Sequence: Synthetic peptide
MYPII

SEQ ID NO: 3582 - protein, 17 aa, Artificial Sequence
  Description of Artificial Sequence: Synthetic peptide
YISPSGGFTGYADSVKG

SEQ ID NO: 3583 - protein, 15 aa, Artificial Sequence
  Description of Artificial Sequence: Synthetic peptide
DRAYGDYVGWNGFDY

SEQ ID NO: 3584 - protein, 11 aa, Artificial Sequence
  Description of Artificial Sequence: Synthetic peptide
RASQSISSFLA

SEQ ID NO: 3585 - protein, 7 aa, Artificial Sequence
  Description of Artificial Sequence: Synthetic peptide
DASYRAT

SEQ ID NO: 3586 - protein, 9 aa, Artificial Sequence
  Description of Artificial Sequence: Synthetic peptide
QQRGNWPIT

SEQ ID NO: 3587 - protein, 5 aa, Artificial Sequence
  Description of Artificial Sequence: Synthetic peptide
MYPMF

SEQ ID NO: 3588 - protein, 17 aa, Artificial Sequence
  Description of Artificial Sequence: Synthetic peptide
YISPSGGWTAYADSVKG

SEQ ID NO: 3589 - protein, 15 aa, Artificial Sequence
  Description of Artificial Sequence: Synthetic peptide
DRAYGDYVGWNGFDY

SEQ ID NO: 3590 - protein, 11 aa, Artificial Sequence
  Description of Artificial Sequence: Synthetic peptide
RASQSISSFLA

SEQ ID NO: 3591 - protein, 7 aa, Artificial Sequence
  Description of Artificial Sequence: Synthetic peptide
DASYRAT

SEQ ID NO: 3592 - protein, 9 aa, Artificial Sequence
  Description of Artificial Sequence: Synthetic peptide
QQRGNWPIT

SEQ ID NO: 3593 - protein, 5 aa, Artificial Sequence
  Description of Artificial Sequence: Synthetic peptide
MYPMF

SEQ ID NO: 3594 - protein, 17 aa, Artificial Sequence
  Description of Artificial Sequence: Synthetic peptide
YISPSGGWTDYADSVKG

SEQ ID NO: 3595 - protein, 15 aa, Artificial Sequence
  Description of Artificial Sequence: Synthetic peptide
DRAYGDYVGWNGFDY

SEQ ID NO: 3596 - protein, 11 aa, Artificial Sequence
  Description of Artificial Sequence: Synthetic peptide
RASQSISSFLA

SEQ ID NO: 3597 - protein, 7 aa, Artificial Sequence
  Description of Artificial Sequence: Synthetic peptide
DASYRAT

SEQ ID NO: 3598 - protein, 9 aa, Artificial Sequence
  Description of Artificial Sequence: Synthetic peptide
QQRGNWPIT

SEQ ID NO: 3599 - protein, 5 aa, Artificial Sequence
  Description of Artificial Sequence: Synthetic peptide
MYPMF

SEQ ID NO: 3600 - protein, 17 aa, Artificial Sequence
  Description of Artificial Sequence: Synthetic peptide
YIVPSGGWTDYADSVKG

SEQ ID NO: 3601 - protein, 15 aa, Artificial Sequence
  Description of Artificial Sequence: Synthetic peptide
DRAYGDYVGWNGFDY

SEQ ID NO: 3602 - protein, 11 aa, Artificial Sequence
  Description of Artificial Sequence: Synthetic peptide
RASQSISSFLA

SEQ ID NO: 3603 - protein, 7 aa, Artificial Sequence
  Description of Artificial Sequence: Synthetic peptide
DASYRAT

SEQ ID NO: 3604 - protein, 9 aa, Artificial Sequence
  Description of Artificial Sequence: Synthetic peptide
QQRGNWPIT

SEQ ID NO: 3605 - protein, 5 aa, Artificial Sequence
  Description of Artificial Sequence: Synthetic peptide
MYPMI

SEQ ID NO: 3606 - protein, 17 aa, Artificial Sequence
  Description of Artificial Sequence: Synthetic peptide
YISPSGGGTFYADSVKG

SEQ ID NO: 3607 - protein, 15 aa, Artificial Sequence
  Description of Artificial Sequence: Synthetic peptide
DRAYGDYVGWNGFDY

SEQ ID NO: 3608 - protein, 11 aa, Artificial Sequence
  Description of Artificial Sequence: Synthetic peptide
RASQSISSFLA

SEQ ID NO: 3609 - protein, 7 aa, Artificial Sequence
  Description of Artificial Sequence: Synthetic peptide
DASYRAT

SEQ ID NO: 3610 - protein, 9 aa, Artificial Sequence
  Description of Artificial Sequence: Synthetic peptide
QQRGNWPIT

SEQ ID NO: 3611 - protein, 5 aa, Artificial Sequence
  Description of Artificial Sequence: Synthetic peptide
MYPMI

SEQ ID NO: 3612 - protein, 17 aa, Artificial Sequence
  Description of Artificial Sequence: Synthetic peptide
YIVPSGGFTGYADSVKG

SEQ ID NO: 3613 - protein, 15 aa, Artificial Sequence
  Description of Artificial Sequence: Synthetic peptide
DRAYGDYVGWNGFDY

SEQ ID NO: 3614 - protein, 11 aa, Artificial Sequence
  Description of Artificial Sequence: Synthetic peptide
RASQSISSFLA

SEQ ID NO: 3615 - protein, 7 aa, Artificial Sequence
  Description of Artificial Sequence: Synthetic peptide
DASYRAT

SEQ ID NO: 3616 - protein, 9 aa, Artificial Sequence
  Description of Artificial Sequence: Synthetic peptide
QQRGNWPIT

SEQ ID NO: 3617 - protein, 5 aa, Artificial Sequence
  Description of Artificial Sequence: Synthetic peptide
MYPML

SEQ ID NO: 3618 - protein, 17 aa, Artificial Sequence
  Description of Artificial Sequence: Synthetic peptide
YISPSGGYTGYADSVKG

SEQ ID NO: 3619 - protein, 15 aa, Artificial Sequence
  Description of Artificial Sequence: Synthetic peptide
DRAYGDYVGWNGFDY

SEQ ID NO: 3620 - protein, 11 aa, Artificial Sequence
  Description of Artificial Sequence: Synthetic peptide
RASQSISSFLA

SEQ ID NO: 3621 - protein, 7 aa, Artificial Sequence
  Description of Artificial Sequence: Synthetic peptide
DASYRAT

SEQ ID NO: 3622 - protein, 9 aa, Artificial Sequence
  Description of Artificial Sequence: Synthetic peptide
QQRGNWPIT

SEQ ID NO: 3623 - protein, 5 aa, Artificial Sequence
  Description of Artificial Sequence: Synthetic peptide
MYPMT

SEQ ID NO: 3624 - protein, 17 aa, Artificial Sequence
  Description of Artificial Sequence: Synthetic peptide
YISPSGGYTGYADSVKG

SEQ ID NO: 3625 - protein, 15 aa, Artificial Sequence
  Description of Artificial Sequence: Synthetic peptide
DRAYGDYVGWNGFDY

SEQ ID NO: 3626 - protein, 11 aa, Artificial Sequence
  Description of Artificial Sequence: Synthetic peptide
RASQSISSFLA

SEQ ID NO: 3627 - protein, 7 aa, Artificial Sequence
  Description of Artificial Sequence: Synthetic peptide
DASYRAT

SEQ ID NO: 3628 - protein, 9 aa, Artificial Sequence
  Description of Artificial Sequence: Synthetic peptide
QQRGNWPIT

SEQ ID NO: 3629 - protein, 5 aa, Artificial Sequence
  Description of Artificial Sequence: Synthetic peptide
MYSMW

SEQ ID NO: 3630 - protein, 17 aa, Artificial Sequence
  Description of Artificial Sequence: Synthetic peptide
VIYPSGGFTDYADSVKG

SEQ ID NO: 3631 - protein, 15 aa, Artificial Sequence
  Description of Artificial Sequence: Synthetic peptide
DRAYGDYVGWNGFDY

SEQ ID NO: 3632 - protein, 11 aa, Artificial Sequence
  Description of Artificial Sequence: Synthetic peptide
RASQSISSFLA

SEQ ID NO: 3633 - protein, 7 aa, Artificial Sequence
  Description of Artificial Sequence: Synthetic peptide
DASYRAT

SEQ ID NO: 3634 - protein, 9 aa, Artificial Sequence
  Description of Artificial Sequence: Synthetic peptide
QQRGNWPIT

SEQ ID NO: 3635 - protein, 5 aa, Artificial Sequence
  Description of Artificial Sequence: Synthetic peptide
MYWML

SEQ ID NO: 3636 - protein, 17 aa, Artificial Sequence
  Description of Artificial Sequence: Synthetic peptide
YISPSGGGTFYADSVKG

SEQ ID NO: 3637 - protein, 15 aa, Artificial Sequence
  Description of Artificial Sequence: Synthetic peptide
DRAYGDYVGWNGFDY

SEQ ID NO: 3638 - protein, 11 aa, Artificial Sequence
  Description of Artificial Sequence: Synthetic peptide
RASQSISSFLA

SEQ ID NO: 3639 - protein, 7 aa, Artificial Sequence
  Description of Artificial Sequence: Synthetic peptide
DASYRAT

SEQ ID NO: 3640 - protein, 9 aa, Artificial Sequence
  Description of Artificial Sequence: Synthetic peptide
QQRGNWPIT

SEQ ID NO: 3641 - protein, 5 aa, Artificial Sequence
  Description of Artificial Sequence: Synthetic peptide
MYWMW

SEQ ID NO: 3642 - protein, 17 aa, Artificial Sequence
  Description of Artificial Sequence: Synthetic peptide
SISSSGGYTGYADSVKG

SEQ ID NO: 3643 - protein, 15 aa, Artificial Sequence
  Description of Artificial Sequence: Synthetic peptide
DRAYGDYVGWNGFDY

SEQ ID NO: 3644 - protein, 11 aa, Artificial Sequence
  Description of Artificial Sequence: Synthetic peptide
RASQSISSFLA

SEQ ID NO: 3645 - protein, 7 aa, Artificial Sequence
  Description of Artificial Sequence: Synthetic peptide
DASYRAT

SEQ ID NO: 3646 - protein, 9 aa, Artificial Sequence
  Description of Artificial Sequence: Synthetic peptide
QQRGNWPIT

SEQ ID NO: 3647 - protein, 5 aa, Artificial Sequence
  Description of Artificial Sequence: Synthetic peptide
NYAMW

SEQ ID NO: 3648 - protein, 16 aa, Artificial Sequence
  Description of Artificial Sequence: Synthetic peptide
YISPSGATYYADSVKG

SEQ ID NO: 3649 - protein, 15 aa, Artificial Sequence
  Description of Artificial Sequence: Synthetic peptide
DRAYGDYVGWNGFDY

SEQ ID NO: 3650 - protein, 11 aa, Artificial Sequence
  Description of Artificial Sequence: Synthetic peptide
RASQSISSFLA

SEQ ID NO: 3651 - protein, 7 aa, Artificial Sequence
  Description of Artificial Sequence: Synthetic peptide
DASYRAT

SEQ ID NO: 3652 - protein, 9 aa, Artificial Sequence
  Description of Artificial Sequence: Synthetic peptide
QQRGNWPIT

SEQ ID NO: 3653 - protein, 5 aa, Artificial Sequence
  Description of Artificial Sequence: Synthetic peptide
NYAMW

SEQ ID NO: 3654 - protein, 17 aa, Artificial Sequence
  Description of Artificial Sequence: Synthetic peptide
YISPSGGSTYYADSVKG

SEQ ID NO: 3655 - protein, 15 aa, Artificial Sequence
  Description of Artificial Sequence: Synthetic peptide
DRAYGDYVGWNGFDY

SEQ ID NO: 3656 - protein, 11 aa, Artificial Sequence
  Description of Artificial Sequence: Synthetic peptide
RASQSISSFLA

SEQ ID NO: 3657 - protein, 7 aa, Artificial Sequence
  Description of Artificial Sequence: Synthetic peptide
DASYRAT

SEQ ID NO: 3658 - protein, 9 aa, Artificial Sequence
  Description of Artificial Sequence: Synthetic peptide
QQRGNWPIT

SEQ ID NO: 3659 - protein, 5 aa, Artificial Sequence
  Description of Artificial Sequence: Synthetic peptide
NYDMA

SEQ ID NO: 3660 - protein, 17 aa, Artificial Sequence
  Description of Artificial Sequence: Synthetic peptide
WISSSGGFTDYADSVKG

SEQ ID NO: 3661 - protein, 15 aa, Artificial Sequence
  Description of Artificial Sequence: Synthetic peptide
DRAYGDYVGWNGFDY

SEQ ID NO: 3662 - protein, 11 aa, Artificial Sequence
  Description of Artificial Sequence: Synthetic peptide
RASQSISSFLA

SEQ ID NO: 3663 - protein, 7 aa, Artificial Sequence
  Description of Artificial Sequence: Synthetic peptide
DASYRAT

SEQ ID NO: 3664 - protein, 9 aa, Artificial Sequence
  Description of Artificial Sequence: Synthetic peptide
QQRGNWPIT

SEQ ID NO: 3665 - protein, 5 aa, Artificial Sequence
  Description of Artificial Sequence: Synthetic peptide
NYDMI

SEQ ID NO: 3666 - protein, 17 aa, Artificial Sequence
  Description of Artificial Sequence: Synthetic peptide
VISPSGGWTSYADSVKG

SEQ ID NO: 3667 - protein, 15 aa, Artificial Sequence
  Description of Artificial Sequence: Synthetic peptide
DRAYGDYVGWNGFDY

SEQ ID NO: 3668 - protein, 11 aa, Artificial Sequence
  Description of Artificial Sequence: Synthetic peptide
RASQSISSFLA

SEQ ID NO: 3669 - protein, 7 aa, Artificial Sequence
  Description of Artificial Sequence: Synthetic peptide
DASYRAT

SEQ ID NO: 3670 - protein, 9 aa, Artificial Sequence
  Description of Artificial Sequence: Synthetic peptide
QQRGNWPIT

SEQ ID NO: 3671 - protein, 5 aa, Artificial Sequence
  Description of Artificial Sequence: Synthetic peptide
NYDMI

SEQ ID NO: 3672 - protein, 17 aa, Artificial Sequence
  Description of Artificial Sequence: Synthetic peptide
YIVPSGGYTAYADSVKG

SEQ ID NO: 3673 - protein, 15 aa, Artificial Sequence
  Description of Artificial Sequence: Synthetic peptide
DRAYGDYVGWNGFDY

SEQ ID NO: 3674 - protein, 11 aa, Artificial Sequence
  Description of Artificial Sequence: Synthetic peptide
RASQSISSFLA

SEQ ID NO: 3675 - protein, 7 aa, Artificial Sequence
  Description of Artificial Sequence: Synthetic peptide
DASYRAT

SEQ ID NO: 3676 - protein, 9 aa, Artificial Sequence
  Description of Artificial Sequence: Synthetic peptide
QQRGNWPIT

SEQ ID NO: 3677 - protein, 5 aa, Artificial Sequence
  Description of Artificial Sequence: Synthetic peptide
NYDMW

SEQ ID NO: 3678 - protein, 17 aa, Artificial Sequence
  Description of Artificial Sequence: Synthetic peptide
VISPSGGFTGYADSVKG

SEQ ID NO: 3679 - protein, 15 aa, Artificial Sequence
  Description of Artificial Sequence: Synthetic peptide
DRAYGDYVGWNGFDY

SEQ ID NO: 3680 - protein, 11 aa, Artificial Sequence
  Description of Artificial Sequence: Synthetic peptide
RASQSISSFLA

SEQ ID NO: 3681 - protein, 7 aa, Artificial Sequence
  Description of Artificial Sequence: Synthetic peptide
DASYRAT

SEQ ID NO: 3682 - protein, 9 aa, Artificial Sequence
  Description of Artificial Sequence: Synthetic peptide
QQRGNWPIT

SEQ ID NO: 3683 - protein, 5 aa, Artificial Sequence
  Description of Artificial Sequence: Synthetic peptide
NYDMW

SEQ ID NO: 3684 - protein, 17 aa, Artificial Sequence
  Description of Artificial Sequence: Synthetic peptide
VISSSGGYTGYADSVKG

SEQ ID NO: 3685 - protein, 15 aa, Artificial Sequence
  Description of Artificial Sequence: Synthetic peptide
DRAYGDYVGWNGFDY

SEQ ID NO: 3686 - protein, 11 aa, Artificial Sequence
  Description of Artificial Sequence: Synthetic peptide
RASQSISSFLA

SEQ ID NO: 3687 - protein, 7 aa, Artificial Sequence
  Description of Artificial Sequence: Synthetic peptide
DASYRAT

SEQ ID NO: 3688 - protein, 9 aa, Artificial Sequence
  Description of Artificial Sequence: Synthetic peptide
QQRGNWPIT

SEQ ID NO: 3689 - protein, 5 aa, Artificial Sequence
  Description of Artificial Sequence: Synthetic peptide
NYDMW

SEQ ID NO: 3690 - protein, 16 aa, Artificial Sequence
  Description of Artificial Sequence: Synthetic peptide
VISSSGMTYYADSVKG

SEQ ID NO: 3691 - protein, 15 aa, Artificial Sequence
  Description of Artificial Sequence: Synthetic peptide
DRAYGDYVGWNGFDY

SEQ ID NO: 3692 - protein, 11 aa, Artificial Sequence
  Description of Artificial Sequence: Synthetic peptide
RASQSISSFLA

SEQ ID NO: 3693 - protein, 7 aa, Artificial Sequence
  Description of Artificial Sequence: Synthetic peptide
DASYRAT

SEQ ID NO: 3694 - protein, 9 aa, Artificial Sequence
  Description of Artificial Sequence: Synthetic peptide
QQRGNWPIT

SEQ ID NO: 3695 - protein, 5 aa, Artificial Sequence
  Description of Artificial Sequence: Synthetic peptide
NYDMW

SEQ ID NO: 3696 - protein, 17 aa, Artificial Sequence
  Description of Artificial Sequence: Synthetic peptide
VIVPSGGATYYADSVKG

SEQ ID NO: 3697 - protein, 15 aa, Artificial Sequence
  Description of Artificial Sequence: Synthetic peptide
DRAYGDYVGWNGFDY

SEQ ID NO: 3698 - protein, 11 aa, Artificial Sequence
  Description of Artificial Sequence: Synthetic peptide
RASQSISSFLA

SEQ ID NO: 3699 - protein, 7 aa, Artificial Sequence
  Description of Artificial Sequence: Synthetic peptide
DASYRAT

SEQ ID NO: 3700 - protein, 9 aa, Artificial Sequence
  Description of Artificial Sequence: Synthetic peptide
QQRGNWPIT

SEQ ID NO: 3701 - protein, 5 aa, Artificial Sequence
  Description of Artificial Sequence: Synthetic peptide
NYDMW

SEQ ID NO: 3702 - protein, 17 aa, Artificial Sequence
  Description of Artificial Sequence: Synthetic peptide
VIYPSGGATFYADSVKG

SEQ ID NO: 3703 - protein, 15 aa, Artificial Sequence
  Description of Artificial Sequence: Synthetic peptide
DRAYGDYVGWNGFDY

SEQ ID NO: 3704 - protein, 11 aa, Artificial Sequence
  Description of Artificial Sequence: Synthetic peptide
RASQSISSFLA

SEQ ID NO: 3705 - protein, 7 aa, Artificial Sequence
  Description of Artificial Sequence: Synthetic peptide
DASYRAT

SEQ ID NO: 3706 - protein, 9 aa, Artificial Sequence
  Description of Artificial Sequence: Synthetic peptide
QQRGNWPIT

SEQ ID NO: 3707 - protein, 5 aa, Artificial Sequence
  Description of Artificial Sequence: Synthetic peptide
NYDMW

SEQ ID NO: 3708 - protein, 17 aa, Artificial Sequence
  Description of Artificial Sequence: Synthetic peptide
VIYPSGGITYYADSVKG

SEQ ID NO: 3709 - protein, 15 aa, Artificial Sequence
  Description of Artificial Sequence: Synthetic peptide
DRAYGDYVGWNGFDY

SEQ ID NO: 3710 - protein, 11 aa, Artificial Sequence
  Description of Artificial Sequence: Synthetic peptide
RASQSISSFLA

SEQ ID NO: 3711 - protein, 7 aa, Artificial Sequence
  Description of Artificial Sequence: Synthetic peptide
DASYRAT

SEQ ID NO: 3712 - protein, 9 aa, Artificial Sequence
  Description of Artificial Sequence: Synthetic peptide
QQRGNWPIT

SEQ ID NO: 3713 - protein, 5 aa, Artificial Sequence
  Description of Artificial Sequence: Synthetic peptide
NYDMW

SEQ ID NO: 3714 - protein, 17 aa, Artificial Sequence
  Description of Artificial Sequence: Synthetic peptide
VIYPSGGPTYYADSVKG

SEQ ID NO: 3715 - protein, 15 aa, Artificial Sequence
  Description of Artificial Sequence: Synthetic peptide
DRAYGDYVGWNGFDY

SEQ ID NO: 3716 - protein, 11 aa, Artificial Sequence
  Description of Artificial Sequence: Synthetic peptide
RASQSISSFLA

SEQ ID NO: 3717 - protein, 7 aa, Artificial Sequence
  Description of Artificial Sequence: Synthetic peptide
DASYRAT

SEQ ID NO: 3718 - protein, 9 aa, Artificial Sequence
  Description of Artificial Sequence: Synthetic peptide
QQRGNWPIT

SEQ ID NO: 3719 - protein, 5 aa, Artificial Sequence
  Description of Artificial Sequence: Synthetic peptide
NYDMW

SEQ ID NO: 3720 - protein, 17 aa, Artificial Sequence
  Description of Artificial Sequence: Synthetic peptide
VIYPSGGYTVYADSVKG

SEQ ID NO: 3721 - protein, 15 aa, Artificial Sequence
  Description of Artificial Sequence: Synthetic peptide
DRAYGDYVGWNGFDY

SEQ ID NO: 3722 - protein, 11 aa, Artificial Sequence
  Description of Artificial Sequence: Synthetic peptide
RASQSISSFLA

SEQ ID NO: 3723 - protein, 7 aa, Artificial Sequence
  Description of Artificial Sequence: Synthetic peptide
DASYRAT

SEQ ID NO: 3724 - protein, 9 aa, Artificial Sequence
  Description of Artificial Sequence: Synthetic peptide
QQRGNWPIT

SEQ ID NO: 3725 - protein, 5 aa, Artificial Sequence
  Description of Artificial Sequence: Synthetic peptide
NYDMW

SEQ ID NO: 3726 - protein, 17 aa, Artificial Sequence
  Description of Artificial Sequence: Synthetic peptide
VIYSSGGPTYYADSVKG

SEQ ID NO: 3727 - protein, 15 aa, Artificial Sequence
  Description of Artificial Sequence: Synthetic peptide
DRAYGDYVGWNGFDY

SEQ ID NO: 3728 - protein, 11 aa, Artificial Sequence
  Description of Artificial Sequence: Synthetic peptide
RASQSISSFLA

SEQ ID NO: 3729 - protein, 7 aa, Artificial Sequence
  Description of Artificial Sequence: Synthetic peptide
DASYRAT

SEQ ID NO: 3730 - protein, 9 aa, Artificial Sequence
  Description of Artificial Sequence: Synthetic peptide
QQRGNWPIT

SEQ ID NO: 3731 - protein, 5 aa, Artificial Sequence
  Description of Artificial Sequence: Synthetic peptide
NYDMW

SEQ ID NO: 3732 - protein, 17 aa, Artificial Sequence
  Description of Artificial Sequence: Synthetic peptide
VIYSSGGYTAYADSVKG

SEQ ID NO: 3733 - protein, 15 aa, Artificial Sequence
  Description of Artificial Sequence: Synthetic peptide
DRAYGDYVGWNGFDY

SEQ ID NO: 3734 - protein, 11 aa, Artificial Sequence
  Description of Artificial Sequence: Synthetic peptide
RASQSISSFLA

SEQ ID NO: 3735 - protein, 7 aa, Artificial Sequence
  Description of Artificial Sequence: Synthetic peptide
DASYRAT

SEQ ID NO: 3736 - protein, 9 aa, Artificial Sequence
  Description of Artificial Sequence: Synthetic peptide
QQRGNWPIT

SEQ ID NO: 3737 - protein, 5 aa, Artificial Sequence
  Description of Artificial Sequence: Synthetic peptide
NYDMW

SEQ ID NO: 3738 - protein, 17 aa, Artificial Sequence
  Description of Artificial Sequence: Synthetic peptide
WISSSGGATIYADSVKG

SEQ ID NO: 3739 - protein, 15 aa, Artificial Sequence
  Description of Artificial Sequence: Synthetic peptide
DRAYGDYVGWNGFDY

SEQ ID NO: 3740 - protein, 11 aa, Artificial Sequence
  Description of Artificial Sequence: Synthetic peptide
RASQSISSFLA

SEQ ID NO: 3741 - protein, 7 aa, Artificial Sequence
  Description of Artificial Sequence: Synthetic peptide
DASYRAT

SEQ ID NO: 3742 - protein, 9 aa, Artificial Sequence
  Description of Artificial Sequence: Synthetic peptide
QQRGNWPIT

SEQ ID NO: 3743 - protein, 5 aa, Artificial Sequence
  Description of Artificial Sequence: Synthetic peptide
NYDMW

SEQ ID NO: 3744 - protein, 17 aa, Artificial Sequence
  Description of Artificial Sequence: Synthetic peptide
YISSSGGATLYADSVKG

SEQ ID NO: 3745 - protein, 15 aa, Artificial Sequence
  Description of Artificial Sequence: Synthetic peptide
DRAYGDYVGWNGFDY

SEQ ID NO: 3746 - protein, 11 aa, Artificial Sequence
  Description of Artificial Sequence: Synthetic peptide
RASQSISSFLA

SEQ ID NO: 3747 - protein, 7 aa, Artificial Sequence
  Description of Artificial Sequence: Synthetic peptide
DASYRAT

SEQ ID NO: 3748 - protein, 9 aa, Artificial Sequence
  Description of Artificial Sequence: Synthetic peptide
QQRGNWPIT

SEQ ID NO: 3749 - protein, 5 aa, Artificial Sequence
  Description of Artificial Sequence: Synthetic peptide
NYEMW

SEQ ID NO: 3750 - protein, 17 aa, Artificial Sequence
  Description of Artificial Sequence: Synthetic peptide
VIYSSGSATFYADSVKG

SEQ ID NO: 3751 - protein, 15 aa, Artificial Sequence
  Description of Artificial Sequence: Synthetic peptide
DRAYGDYVGWNGFDY

SEQ ID NO: 3752 - protein, 11 aa, Artificial Sequence
  Description of Artificial Sequence: Synthetic peptide
RASQSISSFLA

SEQ ID NO: 3753 - protein, 7 aa, Artificial Sequence
  Description of Artificial Sequence: Synthetic peptide
DASYRAT

SEQ ID NO: 3754 - protein, 9 aa, Artificial Sequence
  Description of Artificial Sequence: Synthetic peptide
QQRGNWPIT

SEQ ID NO: 3755 - protein, 5 aa, Artificial Sequence
  Description of Artificial Sequence: Synthetic peptide
NYIMW

SEQ ID NO: 3756 - protein, 17 aa, Artificial Sequence
  Description of Artificial Sequence: Synthetic peptide
SIYPSGGATLYADSVKG

SEQ ID NO: 3757 - protein, 15 aa, Artificial Sequence
  Description of Artificial Sequence: Synthetic peptide
DRAYGDYVGWNGFDY

SEQ ID NO: 3758 - protein, 11 aa, Artificial Sequence
  Description of Artificial Sequence: Synthetic peptide
RASQSISSFLA

SEQ ID NO: 3759 - protein, 7 aa, Artificial Sequence
  Description of Artificial Sequence: Synthetic peptide
DASYRAT

SEQ ID NO: 3760 - protein, 9 aa, Artificial Sequence
  Description of Artificial Sequence: Synthetic peptide
QQRGNWPIT

SEQ ID NO: 3761 - protein, 5 aa, Artificial Sequence
  Description of Artificial Sequence: Synthetic peptide
NYMMI

SEQ ID NO: 3762 - protein, 17 aa, Artificial Sequence
  Description of Artificial Sequence: Synthetic peptide
SIYPSGGYTGYADSVKG

SEQ ID NO: 3763 - protein, 15 aa, Artificial Sequence
  Description of Artificial Sequence: Synthetic peptide
DRAYGDYVGWNGFDY

SEQ ID NO: 3764 - protein, 11 aa, Artificial Sequence
  Description of Artificial Sequence: Synthetic peptide
RASQSISSFLA

SEQ ID NO: 3765 - protein, 7 aa, Artificial Sequence
  Description of Artificial Sequence: Synthetic peptide
DASYRAT

SEQ ID NO: 3766 - protein, 9 aa, Artificial Sequence
  Description of Artificial Sequence: Synthetic peptide
QQRGNWPIT

SEQ ID NO: 3767 - protein, 5 aa, Artificial Sequence
  Description of Artificial Sequence: Synthetic peptide
NYMMI

SEQ ID NO: 3768 - protein, 17 aa, Artificial Sequence
  Description of Artificial Sequence: Synthetic peptide
SIYSSGGFTSYADSVKG

SEQ ID NO: 3769 - protein, 15 aa, Artificial Sequence
  Description of Artificial Sequence: Synthetic peptide
DRAYGDYVGWNGFDY

SEQ ID NO: 3770 - protein, 11 aa, Artificial Sequence
  Description of Artificial Sequence: Synthetic peptide
RASQSISSFLA

SEQ ID NO: 3771 - protein, 7 aa, Artificial Sequence
  Description of Artificial Sequence: Synthetic peptide
DASYRAT

SEQ ID NO: 3772 - protein, 9 aa, Artificial Sequence
  Description of Artificial Sequence: Synthetic peptide
QQRGNWPIT

SEQ ID NO: 3773 - protein, 5 aa, Artificial Sequence
  Description of Artificial Sequence: Synthetic peptide
NYMMW

SEQ ID NO: 3774 - protein, 17 aa, Artificial Sequence
  Description of Artificial Sequence: Synthetic peptide
SIGPSGGGTFYADSVKG

SEQ ID NO: 3775 - protein, 15 aa, Artificial Sequence
  Description of Artificial Sequence: Synthetic peptide
DRAYGDYVGWNGFDY

SEQ ID NO: 3776 - protein, 11 aa, Artificial Sequence
  Description of Artificial Sequence: Synthetic peptide
RASQSISSFLA

SEQ ID NO: 3777 - protein, 7 aa, Artificial Sequence
  Description of Artificial Sequence: Synthetic peptide
DASYRAT

SEQ ID NO: 3778 - protein, 9 aa, Artificial Sequence
  Description of Artificial Sequence: Synthetic peptide
QQRGNWPIT

SEQ ID NO: 3779 - protein, 5 aa, Artificial Sequence
  Description of Artificial Sequence: Synthetic peptide
NYMMW

SEQ ID NO: 3780 - protein, 17 aa, Artificial Sequence
  Description of Artificial Sequence: Synthetic peptide
SIYSSGGGTFYADSVKG

SEQ ID NO: 3781 - protein, 15 aa, Artificial Sequence
  Description of Artificial Sequence: Synthetic peptide
DRAYGDYVGWNGFDY

SEQ ID NO: 3782 - protein, 11 aa, Artificial Sequence
  Description of Artificial Sequence: Synthetic peptide
RASQSISSFLA

SEQ ID NO: 3783 - protein, 7 aa, Artificial Sequence
  Description of Artificial Sequence: Synthetic peptide
DASYRAT

SEQ ID NO: 3784 - protein, 9 aa, Artificial Sequence
  Description of Artificial Sequence: Synthetic peptide
QQRGNWPIT

SEQ ID NO: 3785 - protein, 5 aa, Artificial Sequence
  Description of Artificial Sequence: Synthetic peptide
NYMMW

SEQ ID NO: 3786 - protein, 17 aa, Artificial Sequence
  Description of Artificial Sequence: Synthetic peptide
VISPSGGATYYADSVKG

SEQ ID NO: 3787 - protein, 15 aa, Artificial Sequence
  Description of Artificial Sequence: Synthetic peptide
DRAYGDYVGWNGFDY

SEQ ID NO: 3788 - protein, 11 aa, Artificial Sequence
  Description of Artificial Sequence: Synthetic peptide
RASQSISSFLA

SEQ ID NO: 3789 - protein, 7 aa, Artificial Sequence
  Description of Artificial Sequence: Synthetic peptide
DASYRAT

SEQ ID NO: 3790 - protein, 9 aa, Artificial Sequence
  Description of Artificial Sequence: Synthetic peptide
QQRGNWPIT

SEQ ID NO: 3791 - protein, 5 aa, Artificial Sequence
  Description of Artificial Sequence: Synthetic peptide
NYNMM

SEQ ID NO: 3792 - protein, 17 aa, Artificial Sequence
  Description of Artificial Sequence: Synthetic peptide
YISSSGGYTGYADSVKG

SEQ ID NO: 3793 - protein, 15 aa, Artificial Sequence
  Description of Artificial Sequence: Synthetic peptide
DRAYGDYVGWNGFDY

SEQ ID NO: 3794 - protein, 11 aa, Artificial Sequence
  Description of Artificial Sequence: Synthetic peptide
RASQSISSFLA

SEQ ID NO: 3795 - protein, 7 aa, Artificial Sequence
  Description of Artificial Sequence: Synthetic peptide
DASYRAT

SEQ ID NO: 3796 - protein, 9 aa, Artificial Sequence
  Description of Artificial Sequence: Synthetic peptide
QQRGNWPIT

SEQ ID NO: 3797 - protein, 5 aa, Artificial Sequence
  Description of Artificial Sequence: Synthetic peptide
NYNMW

SEQ ID NO: 3798 - protein, 17 aa, Artificial Sequence
  Description of Artificial Sequence: Synthetic peptide
VIYPSGGPTFYADSVKG

SEQ ID NO: 3799 - protein, 15 aa, Artificial Sequence
  Description of Artificial Sequence: Synthetic peptide
DRAYGDYVGWNGFDY

SEQ ID NO: 3800 - protein, 11 aa, Artificial Sequence
  Description of Artificial Sequence: Synthetic peptide
RASQSISSFLA

SEQ ID NO: 3801 - protein, 7 aa, Artificial Sequence
  Description of Artificial Sequence: Synthetic peptide
DASYRAT

SEQ ID NO: 3802 - protein, 9 aa, Artificial Sequence
  Description of Artificial Sequence: Synthetic peptide
QQRGNWPIT

SEQ ID NO: 3803 - protein, 5 aa, Artificial Sequence
  Description of Artificial Sequence: Synthetic peptide
NYNMW

SEQ ID NO: 3804 - protein, 17 aa, Artificial Sequence
  Description of Artificial Sequence: Synthetic peptide
YISPSGGGTLYADSVKG

SEQ ID NO: 3805 - protein, 15 aa, Artificial Sequence
  Description of Artificial Sequence: Synthetic peptide
DRAYGDYVGWNGFDY

SEQ ID NO: 3806 - protein, 11 aa, Artificial Sequence
  Description of Artificial Sequence: Synthetic peptide
RASQSISSFLA

SEQ ID NO: 3807 - protein, 7 aa, Artificial Sequence
  Description of Artificial Sequence: Synthetic peptide
DASYRAT

SEQ ID NO: 3808 - protein, 9 aa, Artificial Sequence
  Description of Artificial Sequence: Synthetic peptide
QQRGNWPIT

SEQ ID NO: 3809 - protein, 5 aa, Artificial Sequence
  Description of Artificial Sequence: Synthetic peptide
NYPMF

SEQ ID NO: 3810 - protein, 17 aa, Artificial Sequence
  Description of Artificial Sequence: Synthetic peptide
YISPSGGWTSYADSVKG

SEQ ID NO: 3811 - protein, 15 aa, Artificial Sequence
  Description of Artificial Sequence: Synthetic peptide
DRAYGDYVGWNGFDY

SEQ ID NO: 3812 - protein, 11 aa, Artificial Sequence
  Description of Artificial Sequence: Synthetic peptide
RASQSISSFLA

SEQ ID NO: 3813 - protein, 7 aa, Artificial Sequence
  Description of Artificial Sequence: Synthetic peptide
DASYRAT

SEQ ID NO: 3814 - protein, 9 aa, Artificial Sequence
  Description of Artificial Sequence: Synthetic peptide
QQRGNWPIT

SEQ ID NO: 3815 - protein, 5 aa, Artificial Sequence
  Description of Artificial Sequence: Synthetic peptide
NYPMI

SEQ ID NO: 3816 - protein, 17 aa, Artificial Sequence
  Description of Artificial Sequence: Synthetic peptide
YISPSGGGTFYADSVKG

SEQ ID NO: 3817 - protein, 15 aa, Artificial Sequence
  Description of Artificial Sequence: Synthetic peptide
DRAYGDYVGWNGFDY

SEQ ID NO: 3818 - protein, 11 aa, Artificial Sequence
  Description of Artificial Sequence: Synthetic peptide
RASQSISSFLA

SEQ ID NO: 3819 - protein, 7 aa, Artificial Sequence
  Description of Artificial Sequence: Synthetic peptide
DASYRAT

SEQ ID NO: 3820 - protein, 9 aa, Artificial Sequence
  Description of Artificial Sequence: Synthetic peptide
QQRGNWPIT

SEQ ID NO: 3821 - protein, 5 aa, Artificial Sequence
  Description of Artificial Sequence: Synthetic peptide
NYPMI

SEQ ID NO: 3822 - protein, 17 aa, Artificial Sequence
  Description of Artificial Sequence: Synthetic peptide
YISSSGGYTGYADSVKG

SEQ ID NO: 3823 - protein, 15 aa, Artificial Sequence
  Description of Artificial Sequence: Synthetic peptide
DRAYGDYVGWNGFDY

SEQ ID NO: 3824 - protein, 11 aa, Artificial Sequence
  Description of Artificial Sequence: Synthetic peptide
RASQSISSFLA

SEQ ID NO: 3825 - protein, 7 aa, Artificial Sequence
  Description of Artificial Sequence: Synthetic peptide
DASYRAT

SEQ ID NO: 3826 - protein, 9 aa, Artificial Sequence
  Description of Artificial Sequence: Synthetic peptide
QQRGNWPIT

SEQ ID NO: 3827 - protein, 5 aa, Artificial Sequence
  Description of Artificial Sequence: Synthetic peptide
NYPMI

SEQ ID NO: 3828 - protein, 17 aa, Artificial Sequence
  Description of Artificial Sequence: Synthetic peptide
YIVPSGGFTSYADSVKG

SEQ ID NO: 3829 - protein, 15 aa, Artificial Sequence
  Description of Artificial Sequence: Synthetic peptide
DRAYGDYVGWNGFDY

SEQ ID NO: 3830 - protein, 11 aa, Artificial Sequence
  Description of Artificial Sequence: Synthetic peptide
RASQSISSFLA

SEQ ID NO: 3831 - protein, 7 aa, Artificial Sequence
  Description of Artificial Sequence: Synthetic peptide
DASYRAT

SEQ ID NO: 3832 - protein, 9 aa, Artificial Sequence
  Description of Artificial Sequence: Synthetic peptide
QQRGNWPIT

SEQ ID NO: 3833 - protein, 5 aa, Artificial Sequence
  Description of Artificial Sequence: Synthetic peptide
NYPMI

SEQ ID NO: 3834 - protein, 17 aa, Artificial Sequence
  Description of Artificial Sequence: Synthetic peptide
YIYPSGGGTYYADSVKG

SEQ ID NO: 3835 - protein, 15 aa, Artificial Sequence
  Description of Artificial Sequence: Synthetic peptide
DRAYGDYVGWNGFDY

SEQ ID NO: 3836 - protein, 11 aa, Artificial Sequence
  Description of Artificial Sequence: Synthetic peptide
RASQSISSFLA

SEQ ID NO: 3837 - protein, 7 aa, Artificial Sequence
  Description of Artificial Sequence: Synthetic peptide
DASYRAT

SEQ ID NO: 3838 - protein, 9 aa, Artificial Sequence
  Description of Artificial Sequence: Synthetic peptide
QQRGNWPIT

SEQ ID NO: 3839 - protein, 5 aa, Artificial Sequence
  Description of Artificial Sequence: Synthetic peptide
NYPMI

SEQ ID NO: 3840 - protein, 16 aa, Artificial Sequence
  Description of Artificial Sequence: Synthetic peptide
YIYPSGGTFYADSVKG

SEQ ID NO: 3841 - protein, 15 aa, Artificial Sequence
  Description of Artificial Sequence: Synthetic peptide
DRAYGDYVGWNGFDY

SEQ ID NO: 3842 - protein, 11 aa, Artificial Sequence
  Description of Artificial Sequence: Synthetic peptide
RASQSISSFLA

SEQ ID NO: 3843 - protein, 7 aa, Artificial Sequence
  Description of Artificial Sequence: Synthetic peptide
DASYRAT

SEQ ID NO: 3844 - protein, 9 aa, Artificial Sequence
  Description of Artificial Sequence: Synthetic peptide
QQRGNWPIT

SEQ ID NO: 3845 - protein, 5 aa, Artificial Sequence
  Description of Artificial Sequence: Synthetic peptide
NYPMW

SEQ ID NO: 3846 - protein, 17 aa, Artificial Sequence
  Description of Artificial Sequence: Synthetic peptide
SISPSGGSTYYADSVKG

SEQ ID NO: 3847 - protein, 15 aa, Artificial Sequence
  Description of Artificial Sequence: Synthetic peptide
DRAYGDYVGWNGFDY

SEQ ID NO: 3848 - protein, 11 aa, Artificial Sequence
  Description of Artificial Sequence: Synthetic peptide
RASQSISSFLA

SEQ ID NO: 3849 - protein, 7 aa, Artificial Sequence
  Description of Artificial Sequence: Synthetic peptide
DASYRAT

SEQ ID NO: 3850 - protein, 9 aa, Artificial Sequence
  Description of Artificial Sequence: Synthetic peptide
QQRGNWPIT

SEQ ID NO: 3851 - protein, 5 aa, Artificial Sequence
  Description of Artificial Sequence: Synthetic peptide
NYPMW

SEQ ID NO: 3852 - protein, 17 aa, Artificial Sequence
  Description of Artificial Sequence: Synthetic peptide
SIVPSGGATYYADSVKG

SEQ ID NO: 3853 - protein, 15 aa, Artificial Sequence
  Description of Artificial Sequence: Synthetic peptide
DRAYGDYVGWNGFDY

SEQ ID NO: 3854 - protein, 11 aa, Artificial Sequence
  Description of Artificial Sequence: Synthetic peptide
RASQSISSFLA

SEQ ID NO: 3855 - protein, 7 aa, Artificial Sequence
  Description of Artificial Sequence: Synthetic peptide
DASYRAT

SEQ ID NO: 3856 - protein, 9 aa, Artificial Sequence
  Description of Artificial Sequence: Synthetic peptide
QQRGNWPIT

SEQ ID NO: 3857 - protein, 5 aa, Artificial Sequence
  Description of Artificial Sequence: Synthetic peptide
NYPMW

SEQ ID NO: 3858 - protein, 17 aa, Artificial Sequence
  Description of Artificial Sequence: Synthetic peptide
SIYPSGGATFYADSVKG

SEQ ID NO: 3859 - protein, 15 aa, Artificial Sequence
  Description of Artificial Sequence: Synthetic peptide
DRAYGDYVGWNGFDY

SEQ ID NO: 3860 - protein, 11 aa, Artificial Sequence
  Description of Artificial Sequence: Synthetic peptide
RASQSISSFLA

SEQ ID NO: 3861 - protein, 7 aa, Artificial Sequence
  Description of Artificial Sequence: Synthetic peptide
DASYRAT

SEQ ID NO: 3862 - protein, 9 aa, Artificial Sequence
  Description of Artificial Sequence: Synthetic peptide
QQRGNWPIT

SEQ ID NO: 3863 - protein, 5 aa, Artificial Sequence
  Description of Artificial Sequence: Synthetic peptide
NYPMW

SEQ ID NO: 3864 - protein, 18 aa, Artificial Sequence
  Description of Artificial Sequence: Synthetic peptide
SIYPSGGKATYYADSVKG

SEQ ID NO: 3865 - protein, 15 aa, Artificial Sequence
  Description of Artificial Sequence: Synthetic peptide
DRAYGDYVGWNGFDY

SEQ ID NO: 3866 - protein, 11 aa, Artificial Sequence
  Description of Artificial Sequence: Synthetic peptide
RASQSISSFLA

SEQ ID NO: 3867 - protein, 7 aa, Artificial Sequence
  Description of Artificial Sequence: Synthetic peptide
DASYRAT

SEQ ID NO: 3868 - protein, 9 aa, Artificial Sequence
  Description of Artificial Sequence: Synthetic peptide
QQRGNWPIT

SEQ ID NO: 3869 - protein, 5 aa, Artificial Sequence
  Description of Artificial Sequence: Synthetic peptide
NYPMW

SEQ ID NO: 3870 - protein, 17 aa, Artificial Sequence
  Description of Artificial Sequence: Synthetic peptide
SIYPSGGPTFYADSVKG

SEQ ID NO: 3871 - protein, 15 aa, Artificial Sequence
  Description of Artificial Sequence: Synthetic peptide
DRAYGDYVGWNGFDY

SEQ ID NO: 3872 - protein, 11 aa, Artificial Sequence
  Description of Artificial Sequence: Synthetic peptide
RASQSISSFLA

SEQ ID NO: 3873 - protein, 7 aa, Artificial Sequence
  Description of Artificial Sequence: Synthetic peptide
DASYRAT

SEQ ID NO: 3874 - protein, 9 aa, Artificial Sequence
  Description of Artificial Sequence: Synthetic peptide
QQRGNWPIT

SEQ ID NO: 3875 - protein, 5 aa, Artificial Sequence
  Description of Artificial Sequence: Synthetic peptide
NYPMW

SEQ ID NO: 3876 - protein, 17 aa, Artificial Sequence
  Description of Artificial Sequence: Synthetic peptide
SIYSSGGATFYADSVKG

SEQ ID NO: 3877 - protein, 15 aa, Artificial Sequence
  Description of Artificial Sequence: Synthetic peptide
DRAYGDYVGWNGFDY

SEQ ID NO: 3878 - protein, 11 aa, Artificial Sequence
  Description of Artificial Sequence: Synthetic peptide
RASQSISSFLA

SEQ ID NO: 3879 - protein, 7 aa, Artificial Sequence
  Description of Artificial Sequence: Synthetic peptide
DASYRAT

SEQ ID NO: 3880 - protein, 9 aa, Artificial Sequence
  Description of Artificial Sequence: Synthetic peptide
QQRGNWPIT

SEQ ID NO: 3881 - protein, 5 aa, Artificial Sequence
  Description of Artificial Sequence: Synthetic peptide
NYPMW

SEQ ID NO: 3882 - protein, 17 aa, Artificial Sequence
  Description of Artificial Sequence: Synthetic peptide
VIYPSGGYTAYADSVKG

SEQ ID NO: 3883 - protein, 15 aa, Artificial Sequence
  Description of Artificial Sequence: Synthetic peptide
DRAYGDYVGWNGFDY

SEQ ID NO: 3884 - protein, 11 aa, Artificial Sequence
  Description of Artificial Sequence: Synthetic peptide
RASQSISSFLA

SEQ ID NO: 3885 - protein, 7 aa, Artificial Sequence
  Description of Artificial Sequence: Synthetic peptide
DASYRAT

SEQ ID NO: 3886 - protein, 9 aa, Artificial Sequence
  Description of Artificial Sequence: Synthetic peptide
QQRGNWPIT

SEQ ID NO: 3887 - protein, 5 aa, Artificial Sequence
  Description of Artificial Sequence: Synthetic peptide
NYPMW

SEQ ID NO: 3888 - protein, 17 aa, Artificial Sequence
  Description of Artificial Sequence: Synthetic peptide
YIGPSGGGTLYADSVKG

SEQ ID NO: 3889 - protein, 15 aa, Artificial Sequence
  Description of Artificial Sequence: Synthetic peptide
DRAYGDYVGWNGFDY

SEQ ID NO: 3890 - protein, 11 aa, Artificial Sequence
  Description of Artificial Sequence: Synthetic peptide
RASQSISSFLA

SEQ ID NO: 3891 - protein, 7 aa, Artificial Sequence
  Description of Artificial Sequence: Synthetic peptide
DASYRAT

SEQ ID NO: 3892 - protein, 9 aa, Artificial Sequence
  Description of Artificial Sequence: Synthetic peptide
QQRGNWPIT

SEQ ID NO: 3893 - protein, 5 aa, Artificial Sequence
  Description of Artificial Sequence: Synthetic peptide
NYPMW

SEQ ID NO: 3894 - protein, 17 aa, Artificial Sequence
  Description of Artificial Sequence: Synthetic peptide
YIRPSGGPTWYADSVKG

SEQ ID NO: 3895 - protein, 15 aa, Artificial Sequence
  Description of Artificial Sequence: Synthetic peptide
DRAYGDYVGWNGFDY

SEQ ID NO: 3896 - protein, 11 aa, Artificial Sequence
  Description of Artificial Sequence: Synthetic peptide
RASQSISSFLA

SEQ ID NO: 3897 - protein, 7 aa, Artificial Sequence
  Description of Artificial Sequence: Synthetic peptide
DASYRAT

SEQ ID NO: 3898 - protein, 9 aa, Artificial Sequence
  Description of Artificial Sequence: Synthetic peptide
QQRGNWPIT

SEQ ID NO: 3899 - protein, 5 aa, Artificial Sequence
  Description of Artificial Sequence: Synthetic peptide
NYPMW

SEQ ID NO: 3900 - protein, 17 aa, Artificial Sequence
  Description of Artificial Sequence: Synthetic peptide
YISPSGGGTFYADSVKG

SEQ ID NO: 3901 - protein, 15 aa, Artificial Sequence
  Description of Artificial Sequence: Synthetic peptide
DRAYGDYVGWNGFDY

SEQ ID NO: 3902 - protein, 11 aa, Artificial Sequence
  Description of Artificial Sequence: Synthetic peptide
RASQSISSFLA

SEQ ID NO: 3903 - protein, 7 aa, Artificial Sequence
  Description of Artificial Sequence: Synthetic peptide
DASYRAT

SEQ ID NO: 3904 - protein, 9 aa, Artificial Sequence
  Description of Artificial Sequence: Synthetic peptide
QQRGNWPIT

SEQ ID NO: 3905 - protein, 5 aa, Artificial Sequence
  Description of Artificial Sequence: Synthetic peptide
NYPMW

SEQ ID NO: 3906 - protein, 17 aa, Artificial Sequence
  Description of Artificial Sequence: Synthetic peptide
YISPSGGGTLYADSVKG

SEQ ID NO: 3907 - protein, 15 aa, Artificial Sequence
  Description of Artificial Sequence: Synthetic peptide
DRAYGDYVGWNGFDY

SEQ ID NO: 3908 - protein, 11 aa, Artificial Sequence
  Description of Artificial Sequence: Synthetic peptide
RASQSISSFLA

SEQ ID NO: 3909 - protein, 7 aa, Artificial Sequence
  Description of Artificial Sequence: Synthetic peptide
DASYRAT

SEQ ID NO: 3910 - protein, 9 aa, Artificial Sequence
  Description of Artificial Sequence: Synthetic peptide
QQRGNWPIT

SEQ ID NO: 3911 - protein, 5 aa, Artificial Sequence
  Description of Artificial Sequence: Synthetic peptide
NYPMW

SEQ ID NO: 3912 - protein, 17 aa, Artificial Sequence
  Description of Artificial Sequence: Synthetic peptide
YIVPSGGATFYADSVKG

SEQ ID NO: 3913 - protein, 15 aa, Artificial Sequence
  Description of Artificial Sequence: Synthetic peptide
DRAYGDYVGWNGFDY

SEQ ID NO: 3914 - protein, 11 aa, Artificial Sequence
  Description of Artificial Sequence: Synthetic peptide
RASQSISSFLA

SEQ ID NO: 3915 - protein, 7 aa, Artificial Sequence
  Description of Artificial Sequence: Synthetic peptide
DASYRAT

SEQ ID NO: 3916 - protein, 9 aa, Artificial Sequence
  Description of Artificial Sequence: Synthetic peptide
QQRGNWPIT

SEQ ID NO: 3917 - protein, 5 aa, Artificial Sequence
  Description of Artificial Sequence: Synthetic peptide
NYPMW

SEQ ID NO: 3918 - protein, 17 aa, Artificial Sequence
  Description of Artificial Sequence: Synthetic peptide
YIVPSGGMTYYADSVKG

SEQ ID NO: 3919 - protein, 15 aa, Artificial Sequence
  Description of Artificial Sequence: Synthetic peptide
DRAYGDYVGWNGFDY

SEQ ID NO: 3920 - protein, 11 aa, Artificial Sequence
  Description of Artificial Sequence: Synthetic peptide
RASQSISSFLA

SEQ ID NO: 3921 - protein, 7 aa, Artificial Sequence
  Description of Artificial Sequence: Synthetic peptide
DASYRAT

SEQ ID NO: 3922 - protein, 9 aa, Artificial Sequence
  Description of Artificial Sequence: Synthetic peptide
QQRGNWPIT

SEQ ID NO: 3923 - protein, 5 aa, Artificial Sequence
  Description of Artificial Sequence: Synthetic peptide
NYSMW

SEQ ID NO: 3924 - protein, 17 aa, Artificial Sequence
  Description of Artificial Sequence: Synthetic peptide
VIYPSGGYTSYADSVKG

SEQ ID NO: 3925 - protein, 15 aa, Artificial Sequence
  Description of Artificial Sequence: Synthetic peptide
DRAYGDYVGWNGFDY

SEQ ID NO: 3926 - protein, 11 aa, Artificial Sequence
  Description of Artificial Sequence: Synthetic peptide
RASQSISSFLA

SEQ ID NO: 3927 - protein, 7 aa, Artificial Sequence
  Description of Artificial Sequence: Synthetic peptide
DASYRAT

SEQ ID NO: 3928 - protein, 9 aa, Artificial Sequence
  Description of Artificial Sequence: Synthetic peptide
QQRGNWPIT

SEQ ID NO: 3929 - protein, 5 aa, Artificial Sequence
  Description of Artificial Sequence: Synthetic peptide
NYYMI

SEQ ID NO: 3930 - protein, 17 aa, Artificial Sequence
  Description of Artificial Sequence: Synthetic peptide
YISPSGGGTYYADSVKG

SEQ ID NO: 3931 - protein, 15 aa, Artificial Sequence
  Description of Artificial Sequence: Synthetic peptide
DRAYGDYVGWNGFDY

SEQ ID NO: 3932 - protein, 11 aa, Artificial Sequence
  Description of Artificial Sequence: Synthetic peptide
RASQSISSFLA

SEQ ID NO: 3933 - protein, 7 aa, Artificial Sequence
  Description of Artificial Sequence: Synthetic peptide
DASYRAT

SEQ ID NO: 3934 - protein, 9 aa, Artificial Sequence
  Description of Artificial Sequence: Synthetic peptide
QQRGNWPIT

SEQ ID NO: 3935 - protein, 5 aa, Artificial Sequence
  Description of Artificial Sequence: Synthetic peptide
PYAMW

SEQ ID NO: 3936 - protein, 17 aa, Artificial Sequence
  Description of Artificial Sequence: Synthetic peptide
YISSSGGGTFYADSVKG

SEQ ID NO: 3937 - protein, 15 aa, Artificial Sequence
  Description of Artificial Sequence: Synthetic peptide
DRAYGDYVGWNGFDY

SEQ ID NO: 3938 - protein, 11 aa, Artificial Sequence
  Description of Artificial Sequence: Synthetic peptide
RASQSISSFLA

SEQ ID NO: 3939 - protein, 7 aa, Artificial Sequence
  Description of Artificial Sequence: Synthetic peptide
DASYRAT

SEQ ID NO: 3940 - protein, 9 aa, Artificial Sequence
  Description of Artificial Sequence: Synthetic peptide
QQRGNWPIT

SEQ ID NO: 3941 - protein, 5 aa, Artificial Sequence
  Description of Artificial Sequence: Synthetic peptide
PYDMW

SEQ ID NO: 3942 - protein, 17 aa, Artificial Sequence
  Description of Artificial Sequence: Synthetic peptide
VISPSGGATFYADSVKG

SEQ ID NO: 3943 - protein, 15 aa, Artificial Sequence
  Description of Artificial Sequence: Synthetic peptide
DRAYGDYVGWNGFDY

SEQ ID NO: 3944 - protein, 11 aa, Artificial Sequence
  Description of Artificial Sequence: Synthetic peptide
RASQSISSFLA

SEQ ID NO: 3945 - protein, 7 aa, Artificial Sequence
  Description of Artificial Sequence: Synthetic peptide
DASYRAT

SEQ ID NO: 3946 - protein, 9 aa, Artificial Sequence
  Description of Artificial Sequence: Synthetic peptide
QQRGNWPIT

SEQ ID NO: 3947 - protein, 5 aa, Artificial Sequence
  Description of Artificial Sequence: Synthetic peptide
PYDMW

SEQ ID NO: 3948 - protein, 17 aa, Artificial Sequence
  Description of Artificial Sequence: Synthetic peptide
VISPSGGYTGYADSVKG

SEQ ID NO: 3949 - protein, 15 aa, Artificial Sequence
  Description of Artificial Sequence: Synthetic peptide
DRAYGDYVGWNGFDY

SEQ ID NO: 3950 - protein, 11 aa, Artificial Sequence
  Description of Artificial Sequence: Synthetic peptide
RASQSISSFLA

SEQ ID NO: 3951 - protein, 7 aa, Artificial Sequence
  Description of Artificial Sequence: Synthetic peptide
DASYRAT

SEQ ID NO: 3952 - protein, 9 aa, Artificial Sequence
  Description of Artificial Sequence: Synthetic peptide
QQRGNWPIT

SEQ ID NO: 3953 - protein, 5 aa, Artificial Sequence
  Description of Artificial Sequence: Synthetic peptide
PYDMW

SEQ ID NO: 3954 - protein, 17 aa, Artificial Sequence
  Description of Artificial Sequence: Synthetic peptide
VISSSGGFTDYADSVKG

SEQ ID NO: 3955 - protein, 15 aa, Artificial Sequence
  Description of Artificial Sequence: Synthetic peptide
DRAYGDYVGWNGFDY

SEQ ID NO: 3956 - protein, 11 aa, Artificial Sequence
  Description of Artificial Sequence: Synthetic peptide
RASQSISSFLA

SEQ ID NO: 3957 - protein, 7 aa, Artificial Sequence
  Description of Artificial Sequence: Synthetic peptide
DASYRAT

SEQ ID NO: 3958 - protein, 9 aa, Artificial Sequence
  Description of Artificial Sequence: Synthetic peptide
QQRGNWPIT

SEQ ID NO: 3959 - protein, 5 aa, Artificial Sequence
  Description of Artificial Sequence: Synthetic peptide
PYMMF

SEQ ID NO: 3960 - protein, 17 aa, Artificial Sequence
  Description of Artificial Sequence: Synthetic peptide
SISSSGGGTFYADSVKG

SEQ ID NO: 3961 - protein, 15 aa, Artificial Sequence
  Description of Artificial Sequence: Synthetic peptide
DRAYGDYVGWNGFDY

SEQ ID NO: 3962 - protein, 11 aa, Artificial Sequence
  Description of Artificial Sequence: Synthetic peptide
RASQSISSFLA

SEQ ID NO: 3963 - protein, 7 aa, Artificial Sequence
  Description of Artificial Sequence: Synthetic peptide
DASYRAT

SEQ ID NO: 3964 - protein, 9 aa, Artificial Sequence
  Description of Artificial Sequence: Synthetic peptide
QQRGNWPIT

SEQ ID NO: 3965 - protein, 5 aa, Artificial Sequence
  Description of Artificial Sequence: Synthetic peptide
PYMMI

SEQ ID NO: 3966 - protein, 17 aa, Artificial Sequence
  Description of Artificial Sequence: Synthetic peptide
SISSSGGYTGYADSVKG

SEQ ID NO: 3967 - protein, 15 aa, Artificial Sequence
  Description of Artificial Sequence: Synthetic peptide
DRAYGDYVGWNGFDY

SEQ ID NO: 3968 - protein, 11 aa, Artificial Sequence
  Description of Artificial Sequence: Synthetic peptide
RASQSISSFLA

SEQ ID NO: 3969 - protein, 7 aa, Artificial Sequence
  Description of Artificial Sequence: Synthetic peptide
DASYRAT

SEQ ID NO: 3970 - protein, 9 aa, Artificial Sequence
  Description of Artificial Sequence: Synthetic peptide
QQRGNWPIT

SEQ ID NO: 3971 - protein, 5 aa, Artificial Sequence
  Description of Artificial Sequence: Synthetic peptide
PYMMS

SEQ ID NO: 3972 - protein, 17 aa, Artificial Sequence
  Description of Artificial Sequence: Synthetic peptide
SIYSSGGATFYADSVKG

SEQ ID NO: 3973 - protein, 15 aa, Artificial Sequence
  Description of Artificial Sequence: Synthetic peptide
DRAYGDYVGWNGFDY

SEQ ID NO: 3974 - protein, 11 aa, Artificial Sequence
  Description of Artificial Sequence: Synthetic peptide
RASQSISSFLA

SEQ ID NO: 3975 - protein, 7 aa, Artificial Sequence
  Description of Artificial Sequence: Synthetic peptide
DASYRAT

SEQ ID NO: 3976 - protein, 9 aa, Artificial Sequence
  Description of Artificial Sequence: Synthetic peptide
QQRGNWPIT

SEQ ID NO: 3977 - protein, 5 aa, Artificial Sequence
  Description of Artificial Sequence: Synthetic peptide
PYMMW

SEQ ID NO: 3978 - protein, 17 aa, Artificial Sequence
  Description of Artificial Sequence: Synthetic peptide
SISSSGGGTFYADSVKG

SEQ ID NO: 3979 - protein, 15 aa, Artificial Sequence
  Description of Artificial Sequence: Synthetic peptide
DRAYGDYVGWNGFDY

SEQ ID NO: 3980 - protein, 11 aa, Artificial Sequence
  Description of Artificial Sequence: Synthetic peptide
RASQSISSFLA

SEQ ID NO: 3981 - protein, 7 aa, Artificial Sequence
  Description of Artificial Sequence: Synthetic peptide
DASYRAT

SEQ ID NO: 3982 - protein, 9 aa, Artificial Sequence
  Description of Artificial Sequence: Synthetic peptide
QQRGNWPIT

SEQ ID NO: 3983 - protein, 5 aa, Artificial Sequence
  Description of Artificial Sequence: Synthetic peptide
PYNMW

SEQ ID NO: 3984 - protein, 17 aa, Artificial Sequence
  Description of Artificial Sequence: Synthetic peptide
VIYPSGGATFYADSVKG

SEQ ID NO: 3985 - protein, 15 aa, Artificial Sequence
  Description of Artificial Sequence: Synthetic peptide
DRAYGDYVGWNGFDY

SEQ ID NO: 3986 - protein, 11 aa, Artificial Sequence
  Description of Artificial Sequence: Synthetic peptide
RASQSISSFLA

SEQ ID NO: 3987 - protein, 7 aa, Artificial Sequence
  Description of Artificial Sequence: Synthetic peptide
DASYRAT

SEQ ID NO: 3988 - protein, 9 aa, Artificial Sequence
  Description of Artificial Sequence: Synthetic peptide
QQRGNWPIT

SEQ ID NO: 3989 - protein, 5 aa, Artificial Sequence
  Description of Artificial Sequence: Synthetic peptide
PYPMF

SEQ ID NO: 3990 - protein, 17 aa, Artificial Sequence
  Description of Artificial Sequence: Synthetic peptide
SISPSGGATYYADSVKG

SEQ ID NO: 3991 - protein, 15 aa, Artificial Sequence
  Description of Artificial Sequence: Synthetic peptide
DRAYGDYVGWNGFDY

SEQ ID NO: 3992 - protein, 11 aa, Artificial Sequence
  Description of Artificial Sequence: Synthetic peptide
RASQSISSFLA

SEQ ID NO: 3993 - protein, 7 aa, Artificial Sequence
  Description of Artificial Sequence: Synthetic peptide
DASYRAT

SEQ ID NO: 3994 - protein, 9 aa, Artificial Sequence
  Description of Artificial Sequence: Synthetic peptide
QQRGNWPIT

SEQ ID NO: 3995 - protein, 5 aa, Artificial Sequence
  Description of Artificial Sequence: Synthetic peptide
PYPMI

SEQ ID NO: 3996 - protein, 17 aa, Artificial Sequence
  Description of Artificial Sequence: Synthetic peptide
YIGSSGGYTSYADSVKG

SEQ ID NO: 3997 - protein, 15 aa, Artificial Sequence
  Description of Artificial Sequence: Synthetic peptide
DRAYGDYVGWNGFDY

SEQ ID NO: 3998 - protein, 11 aa, Artificial Sequence
  Description of Artificial Sequence: Synthetic peptide
RASQSISSFLA

SEQ ID NO: 3999 - protein, 7 aa, Artificial Sequence
  Description of Artificial Sequence: Synthetic peptide
DASYRAT

SEQ ID NO: 4000 - protein, 9 aa, Artificial Sequence
  Description of Artificial Sequence: Synthetic peptide
QQRGNWPIT

SEQ ID NO: 4001 - protein, 5 aa, Artificial Sequence
  Description of Artificial Sequence: Synthetic peptide
PYPMI

SEQ ID NO: 4002 - protein, 17 aa, Artificial Sequence
  Description of Artificial Sequence: Synthetic peptide
YISPSGGFTDYADSVKG

SEQ ID NO: 4003 - protein, 15 aa, Artificial Sequence
  Description of Artificial Sequence: Synthetic peptide
DRAYGDYVGWNGFDY

SEQ ID NO: 4004 - protein, 11 aa, Artificial Sequence
  Description of Artificial Sequence: Synthetic peptide
RASQSISSFLA

SEQ ID NO: 4005 - protein, 7 aa, Artificial Sequence
  Description of Artificial Sequence: Synthetic peptide
DASYRAT

SEQ ID NO: 4006 - protein, 9 aa, Artificial Sequence
  Description of Artificial Sequence: Synthetic peptide
QQRGNWPIT

SEQ ID NO: 4007 - protein, 5 aa, Artificial Sequence
  Description of Artificial Sequence: Synthetic peptide
PYPMI

SEQ ID NO: 4008 - protein, 17 aa, Artificial Sequence
  Description of Artificial Sequence: Synthetic peptide
YISPSGGGTFYADSVKG

SEQ ID NO: 4009 - protein, 15 aa, Artificial Sequence
  Description of Artificial Sequence: Synthetic peptide
DRAYGDYVGWNGFDY

SEQ ID NO: 4010 - protein, 11 aa, Artificial Sequence
  Description of Artificial Sequence: Synthetic peptide
RASQSISSFLA

SEQ ID NO: 4011 - protein, 7 aa, Artificial Sequence
  Description of Artificial Sequence: Synthetic peptide
DASYRAT

SEQ ID NO: 4012 - protein, 9 aa, Artificial Sequence
  Description of Artificial Sequence: Synthetic peptide
QQRGNWPIT

SEQ ID NO: 4013 - protein, 5 aa, Artificial Sequence
  Description of Artificial Sequence: Synthetic peptide
PYPMI

SEQ ID NO: 4014 - protein, 17 aa, Artificial Sequence
  Description of Artificial Sequence: Synthetic peptide
YISSSGGGTYYADSVKG

SEQ ID NO: 4015 - protein, 15 aa, Artificial Sequence
  Description of Artificial Sequence: Synthetic peptide
DRAYGDYVGWNGFDY

SEQ ID NO: 4016 - protein, 11 aa, Artificial Sequence
  Description of Artificial Sequence: Synthetic peptide
RASQSISSFLA

SEQ ID NO: 4017 - protein, 7 aa, Artificial Sequence
  Description of Artificial Sequence: Synthetic peptide
DASYRAT

SEQ ID NO: 4018 - protein, 9 aa, Artificial Sequence
  Description of Artificial Sequence: Synthetic peptide
QQRGNWPIT

SEQ ID NO: 4019 - protein, 5 aa, Artificial Sequence
  Description of Artificial Sequence: Synthetic peptide
PYPMI

SEQ ID NO: 4020 - protein, 17 aa, Artificial Sequence
  Description of Artificial Sequence: Synthetic peptide
YISSSGGYTDYADSVKG

SEQ ID NO: 4021 - protein, 15 aa, Artificial Sequence
  Description of Artificial Sequence: Synthetic peptide
DRAYGDYVGWNGFDY

SEQ ID NO: 4022 - protein, 11 aa, Artificial Sequence
  Description of Artificial Sequence: Synthetic peptide
RASQSISSFLA

SEQ ID NO: 4023 - protein, 7 aa, Artificial Sequence
  Description of Artificial Sequence: Synthetic peptide
DASYRAT

SEQ ID NO: 4024 - protein, 9 aa, Artificial Sequence
  Description of Artificial Sequence: Synthetic peptide
QQRGNWPIT

SEQ ID NO: 4025 - protein, 5 aa, Artificial Sequence
  Description of Artificial Sequence: Synthetic peptide
PYPMW

SEQ ID NO: 4026 - protein, 17 aa, Artificial Sequence
  Description of Artificial Sequence: Synthetic peptide
YISPSGGWTDYADSVKG

SEQ ID NO: 4027 - protein, 15 aa, Artificial Sequence
  Description of Artificial Sequence: Synthetic peptide
DRAYGDYVGWNGFDY

SEQ ID NO: 4028 - protein, 11 aa, Artificial Sequence
  Description of Artificial Sequence: Synthetic peptide
RASQSISSFLA

SEQ ID NO: 4029 - protein, 7 aa, Artificial Sequence
  Description of Artificial Sequence: Synthetic peptide
DASYRAT

SEQ ID NO: 4030 - protein, 9 aa, Artificial Sequence
  Description of Artificial Sequence: Synthetic peptide
QQRGNWPIT

SEQ ID NO: 4031 - protein, 5 aa, Artificial Sequence
  Description of Artificial Sequence: Synthetic peptide
PYPMW

SEQ ID NO: 4032 - protein, 17 aa, Artificial Sequence
  Description of Artificial Sequence: Synthetic peptide
YIVPSGGKTFYADSVKG

SEQ ID NO: 4033 - protein, 15 aa, Artificial Sequence
  Description of Artificial Sequence: Synthetic peptide
DRAYGDYVGWNGFDY

SEQ ID NO: 4034 - protein, 11 aa, Artificial Sequence
  Description of Artificial Sequence: Synthetic peptide
RASQSISSFLA

SEQ ID NO: 4035 - protein, 7 aa, Artificial Sequence
  Description of Artificial Sequence: Synthetic peptide
DASYRAT

SEQ ID NO: 4036 - protein, 9 aa, Artificial Sequence
  Description of Artificial Sequence: Synthetic peptide
QQRGNWPIT

SEQ ID NO: 4037 - protein, 5 aa, Artificial Sequence
  Description of Artificial Sequence: Synthetic peptide
QYAMI

SEQ ID NO: 4038 - protein, 17 aa, Artificial Sequence
  Description of Artificial Sequence: Synthetic peptide
YISPSGGYTGYADSVKG

SEQ ID NO: 4039 - protein, 15 aa, Artificial Sequence
  Description of Artificial Sequence: Synthetic peptide
DRAYGDYVGWNGFDY

SEQ ID NO: 4040 - protein, 11 aa, Artificial Sequence
  Description of Artificial Sequence: Synthetic peptide
RASQSISSFLA

SEQ ID NO: 4041 - protein, 7 aa, Artificial Sequence
  Description of Artificial Sequence: Synthetic peptide
DASYRAT

SEQ ID NO: 4042 - protein, 9 aa, Artificial Sequence
  Description of Artificial Sequence: Synthetic peptide
QQRGNWPIT

SEQ ID NO: 4043 - protein, 5 aa, Artificial Sequence
  Description of Artificial Sequence: Synthetic peptide
QYDMI

SEQ ID NO: 4044 - protein, 17 aa, Artificial Sequence
  Description of Artificial Sequence: Synthetic peptide
YIGSSGGSTIYADSVKG

SEQ ID NO: 4045 - protein, 15 aa, Artificial Sequence
  Description of Artificial Sequence: Synthetic peptide
DRAYGDYVGWNGFDY

SEQ ID NO: 4046 - protein, 11 aa, Artificial Sequence
  Description of Artificial Sequence: Synthetic peptide
RASQSISSFLA

SEQ ID NO: 4047 - protein, 7 aa, Artificial Sequence
  Description of Artificial Sequence: Synthetic peptide
DASYRAT

SEQ ID NO: 4048 - protein, 9 aa, Artificial Sequence
  Description of Artificial Sequence: Synthetic peptide
QQRGNWPIT

SEQ ID NO: 4049 - protein, 5 aa, Artificial Sequence
  Description of Artificial Sequence: Synthetic peptide
QYDMW

SEQ ID NO: 4050 - protein, 17 aa, Artificial Sequence
  Description of Artificial Sequence: Synthetic peptide
VISPSGGHTSYADSVKG

SEQ ID NO: 4051 - protein, 15 aa, Artificial Sequence
  Description of Artificial Sequence: Synthetic peptide
DRAYGDYVGWNGFDY

SEQ ID NO: 4052 - protein, 11 aa, Artificial Sequence
  Description of Artificial Sequence: Synthetic peptide
RASQSISSFLA

SEQ ID NO: 4053 - protein, 7 aa, Artificial Sequence
  Description of Artificial Sequence: Synthetic peptide
DASYRAT

SEQ ID NO: 4054 - protein, 9 aa, Artificial Sequence
  Description of Artificial Sequence: Synthetic peptide
QQRGNWPIT

SEQ ID NO: 4055 - protein, 5 aa, Artificial Sequence
  Description of Artificial Sequence: Synthetic peptide
QYDMW

SEQ ID NO: 4056 - protein, 17 aa, Artificial Sequence
  Description of Artificial Sequence: Synthetic peptide
VISSSGGATWYADSVKG

SEQ ID NO: 4057 - protein, 15 aa, Artificial Sequence
  Description of Artificial Sequence: Synthetic peptide
DRAYGDYVGWNGFDY

SEQ ID NO: 4058 - protein, 11 aa, Artificial Sequence
  Description of Artificial Sequence: Synthetic peptide
RASQSISSFLA

SEQ ID NO: 4059 - protein, 7 aa, Artificial Sequence
  Description of Artificial Sequence: Synthetic peptide
DASYRAT

SEQ ID NO: 4060 - protein, 9 aa, Artificial Sequence
  Description of Artificial Sequence: Synthetic peptide
QQRGNWPIT

SEQ ID NO: 4061 - protein, 5 aa, Artificial Sequence
  Description of Artificial Sequence: Synthetic peptide
QYDMW

SEQ ID NO: 4062 - protein, 17 aa, Artificial Sequence
  Description of Artificial Sequence: Synthetic peptide
VIYPSGGPTFYADSVKG

SEQ ID NO: 4063 - protein, 15 aa, Artificial Sequence
  Description of Artificial Sequence: Synthetic peptide
DRAYGDYVGWNGFDY

SEQ ID NO: 4064 - protein, 11 aa, Artificial Sequence
  Description of Artificial Sequence: Synthetic peptide
RASQSISSFLA

SEQ ID NO: 4065 - protein, 7 aa, Artificial Sequence
  Description of Artificial Sequence: Synthetic peptide
DASYRAT

SEQ ID NO: 4066 - protein, 9 aa, Artificial Sequence
  Description of Artificial Sequence: Synthetic peptide
QQRGNWPIT

SEQ ID NO: 4067 - protein, 5 aa, Artificial Sequence
  Description of Artificial Sequence: Synthetic peptide
QYDMW

SEQ ID NO: 4068 - protein, 17 aa, Artificial Sequence
  Description of Artificial Sequence: Synthetic peptide
VIYPSGGTTFYADSVKG

SEQ ID NO: 4069 - protein, 15 aa, Artificial Sequence
  Description of Artificial Sequence: Synthetic peptide
DRAYGDYVGWNGFDY

SEQ ID NO: 4070 - protein, 11 aa, Artificial Sequence
  Description of Artificial Sequence: Synthetic peptide
RASQSISSFLA

SEQ ID NO: 4071 - protein, 7 aa, Artificial Sequence
  Description of Artificial Sequence: Synthetic peptide
DASYRAT

SEQ ID NO: 4072 - protein, 9 aa, Artificial Sequence
  Description of Artificial Sequence: Synthetic peptide
QQRGNWPIT

SEQ ID NO: 4073 - protein, 5 aa, Artificial Sequence
  Description of Artificial Sequence: Synthetic peptide
QYDMW

SEQ ID NO: 4074 - protein, 17 aa, Artificial Sequence
  Description of Artificial Sequence: Synthetic peptide
VIYPSGGYTDYADSVKG

SEQ ID NO: 4075 - protein, 15 aa, Artificial Sequence
  Description of Artificial Sequence: Synthetic peptide
DRAYGDYVGWNGFDY

SEQ ID NO: 4076 - protein, 11 aa, Artificial Sequence
  Description of Artificial Sequence: Synthetic peptide
RASQSISSFLA

SEQ ID NO: 4077 - protein, 7 aa, Artificial Sequence
  Description of Artificial Sequence: Synthetic peptide
DASYRAT

SEQ ID NO: 4078 - protein, 9 aa, Artificial Sequence
  Description of Artificial Sequence: Synthetic peptide
QQRGNWPIT

SEQ ID NO: 4079 - protein, 5 aa, Artificial Sequence
  Description of Artificial Sequence: Synthetic peptide
QYDMW

SEQ ID NO: 4080 - protein, 16 aa, Artificial Sequence
  Description of Artificial Sequence: Synthetic peptide
VIYPSGTTFYADSVKG

SEQ ID NO: 4081 - protein, 15 aa, Artificial Sequence
  Description of Artificial Sequence: Synthetic peptide
DRAYGDYVGWNGFDY

SEQ ID NO: 4082 - protein, 11 aa, Artificial Sequence
  Description of Artificial Sequence: Synthetic peptide
RASQSISSFLA

SEQ ID NO: 4083 - protein, 7 aa, Artificial Sequence
  Description of Artificial Sequence: Synthetic peptide
DASYRAT

SEQ ID NO: 4084 - protein, 9 aa, Artificial Sequence
  Description of Artificial Sequence: Synthetic peptide
QQRGNWPIT

SEQ ID NO: 4085 - protein, 5 aa, Artificial Sequence
  Description of Artificial Sequence: Synthetic peptide
QYDMW

SEQ ID NO: 4086 - protein, 17 aa, Artificial Sequence
  Description of Artificial Sequence: Synthetic peptide
YIVPSGGFTDYADSVKG

SEQ ID NO: 4087 - protein, 15 aa, Artificial Sequence
  Description of Artificial Sequence: Synthetic peptide
DRAYGDYVGWNGFDY

SEQ ID NO: 4088 - protein, 11 aa, Artificial Sequence
  Description of Artificial Sequence: Synthetic peptide
RASQSISSFLA

SEQ ID NO: 4089 - protein, 7 aa, Artificial Sequence
  Description of Artificial Sequence: Synthetic peptide
DASYRAT

SEQ ID NO: 4090 - protein, 9 aa, Artificial Sequence
  Description of Artificial Sequence: Synthetic peptide
QQRGNWPIT

SEQ ID NO: 4091 - protein, 5 aa, Artificial Sequence
  Description of Artificial Sequence: Synthetic peptide
QYGMW

SEQ ID NO: 4092 - protein, 17 aa, Artificial Sequence
  Description of Artificial Sequence: Synthetic peptide
YIYPSGGGTYYADSVKG

SEQ ID NO: 4093 - protein, 15 aa, Artificial Sequence
  Description of Artificial Sequence: Synthetic peptide
DRAYGDYVGWNGFDY

SEQ ID NO: 4094 - protein, 11 aa, Artificial Sequence
  Description of Artificial Sequence: Synthetic peptide
RASQSISSFLA

SEQ ID NO: 4095 - protein, 7 aa, Artificial Sequence
  Description of Artificial Sequence: Synthetic peptide
DASYRAT

SEQ ID NO: 4096 - protein, 9 aa, Artificial Sequence
  Description of Artificial Sequence: Synthetic peptide
QQRGNWPIT

SEQ ID NO: 4097 - protein, 5 aa, Artificial Sequence
  Description of Artificial Sequence: Synthetic peptide
QYMMI

SEQ ID NO: 4098 - protein, 17 aa, Artificial Sequence
  Description of Artificial Sequence: Synthetic peptide
YIVPSGGTTGYADSVKG

SEQ ID NO: 4099 - protein, 15 aa, Artificial Sequence
  Description of Artificial Sequence: Synthetic peptide
DRAYGDYVGWNGFDY

SEQ ID NO: 4100 - protein, 11 aa, Artificial Sequence
  Description of Artificial Sequence: Synthetic peptide
RASQSISSFLA

SEQ ID NO: 4101 - protein, 7 aa, Artificial Sequence
  Description of Artificial Sequence: Synthetic peptide
DASYRAT

SEQ ID NO: 4102 - protein, 9 aa, Artificial Sequence
  Description of Artificial Sequence: Synthetic peptide
QQRGNWPIT

SEQ ID NO: 4103 - protein, 5 aa, Artificial Sequence
  Description of Artificial Sequence: Synthetic peptide
QYPMF

SEQ ID NO: 4104 - protein, 17 aa, Artificial Sequence
  Description of Artificial Sequence: Synthetic peptide
YIVPSGGYTSYADSVKG

SEQ ID NO: 4105 - protein, 15 aa, Artificial Sequence
  Description of Artificial Sequence: Synthetic peptide
DRAYGDYVGWNGFDY

SEQ ID NO: 4106 - protein, 11 aa, Artificial Sequence
  Description of Artificial Sequence: Synthetic peptide
RASQSISSFLA

SEQ ID NO: 4107 - protein, 7 aa, Artificial Sequence
  Description of Artificial Sequence: Synthetic peptide
DASYRAT

SEQ ID NO: 4108 - protein, 9 aa, Artificial Sequence
  Description of Artificial Sequence: Synthetic peptide
QQRGNWPIT

SEQ ID NO: 4109 - protein, 5 aa, Artificial Sequence
  Description of Artificial Sequence: Synthetic peptide
QYPMI

SEQ ID NO: 4110 - protein, 17 aa, Artificial Sequence
  Description of Artificial Sequence: Synthetic peptide
YIVPSGGWTSYADSVKG

SEQ ID NO: 4111 - protein, 15 aa, Artificial Sequence
  Description of Artificial Sequence: Synthetic peptide
DRAYGDYVGWNGFDY

SEQ ID NO: 4112 - protein, 11 aa, Artificial Sequence
  Description of Artificial Sequence: Synthetic peptide
RASQSISSFLA

SEQ ID NO: 4113 - protein, 7 aa, Artificial Sequence
  Description of Artificial Sequence: Synthetic peptide
DASYRAT

SEQ ID NO: 4114 - protein, 9 aa, Artificial Sequence
  Description of Artificial Sequence: Synthetic peptide
QQRGNWPIT

SEQ ID NO: 4115 - protein, 5 aa, Artificial Sequence
  Description of Artificial Sequence: Synthetic peptide
QYPMM

SEQ ID NO: 4116 - protein, 17 aa, Artificial Sequence
  Description of Artificial Sequence: Synthetic peptide
YIYPSGGATYYADSVKG

SEQ ID NO: 4117 - protein, 15 aa, Artificial Sequence
  Description of Artificial Sequence: Synthetic peptide
DRAYGDYVGWNGFDY

SEQ ID NO: 4118 - protein, 11 aa, Artificial Sequence
  Description of Artificial Sequence: Synthetic peptide
RASQSISSFLA

SEQ ID NO: 4119 - protein, 7 aa, Artificial Sequence
  Description of Artificial Sequence: Synthetic peptide
DASYRAT

SEQ ID NO: 4120 - protein, 9 aa, Artificial Sequence
  Description of Artificial Sequence: Synthetic peptide
QQRGNWPIT

SEQ ID NO: 4121 - protein, 5 aa, Artificial Sequence
  Description of Artificial Sequence: Synthetic peptide
QYPMM

SEQ ID NO: 4122 - protein, 17 aa, Artificial Sequence
  Description of Artificial Sequence: Synthetic peptide
YIYPSGGGTYYADSVKG

SEQ ID NO: 4123 - protein, 15 aa, Artificial Sequence
  Description of Artificial Sequence: Synthetic peptide
DRAYGDYVGWNGFDY

SEQ ID NO: 4124 - protein, 11 aa, Artificial Sequence
  Description of Artificial Sequence: Synthetic peptide
RASQSISSFLA

SEQ ID NO: 4125 - protein, 7 aa, Artificial Sequence
  Description of Artificial Sequence: Synthetic peptide
DASYRAT

SEQ ID NO: 4126 - protein, 9 aa, Artificial Sequence
  Description of Artificial Sequence: Synthetic peptide
QQRGNWPIT

SEQ ID NO: 4127 - protein, 5 aa, Artificial Sequence
  Description of Artificial Sequence: Synthetic peptide
QYPMW

SEQ ID NO: 4128 - protein, 17 aa, Artificial Sequence
  Description of Artificial Sequence: Synthetic peptide
SISPSGGATYYADSVKG

SEQ ID NO: 4129 - protein, 15 aa, Artificial Sequence
  Description of Artificial Sequence: Synthetic peptide
DRAYGDYVGWNGFDY

SEQ ID NO: 4130 - protein, 11 aa, Artificial Sequence
  Description of Artificial Sequence: Synthetic peptide
RASQSISSFLA

SEQ ID NO: 4131 - protein, 7 aa, Artificial Sequence
  Description of Artificial Sequence: Synthetic peptide
DASYRAT

SEQ ID NO: 4132 - protein, 9 aa, Artificial Sequence
  Description of Artificial Sequence: Synthetic peptide
QQRGNWPIT

SEQ ID NO: 4133 - protein, 5 aa, Artificial Sequence
  Description of Artificial Sequence: Synthetic peptide
QYPMW

SEQ ID NO: 4134 - protein, 17 aa, Artificial Sequence
  Description of Artificial Sequence: Synthetic peptide
SIYPSGGGTFYADSVKG

SEQ ID NO: 4135 - protein, 15 aa, Artificial Sequence
  Description of Artificial Sequence: Synthetic peptide
DRAYGDYVGWNGFDY

SEQ ID NO: 4136 - protein, 11 aa, Artificial Sequence
  Description of Artificial Sequence: Synthetic peptide
RASQSISSFLA

SEQ ID NO: 4137 - protein, 7 aa, Artificial Sequence
  Description of Artificial Sequence: Synthetic peptide
DASYRAT

SEQ ID NO: 4138 - protein, 9 aa, Artificial Sequence
  Description of Artificial Sequence: Synthetic peptide
QQRGNWPIT

SEQ ID NO: 4139 - protein, 5 aa, Artificial Sequence
  Description of Artificial Sequence: Synthetic peptide
QYPMW

SEQ ID NO: 4140 - protein, 17 aa, Artificial Sequence
  Description of Artificial Sequence: Synthetic peptide
SIYSSGGATYYADSVKG

SEQ ID NO: 4141 - protein, 15 aa, Artificial Sequence
  Description of Artificial Sequence: Synthetic peptide
DRAYGDYVGWNGFDY

SEQ ID NO: 4142 - protein, 11 aa, Artificial Sequence
  Description of Artificial Sequence: Synthetic peptide
RASQSISSFLA

SEQ ID NO: 4143 - protein, 7 aa, Artificial Sequence
  Description of Artificial Sequence: Synthetic peptide
DASYRAT

SEQ ID NO: 4144 - protein, 9 aa, Artificial Sequence
  Description of Artificial Sequence: Synthetic peptide
QQRGNWPIT

SEQ ID NO: 4145 - protein, 5 aa, Artificial Sequence
  Description of Artificial Sequence: Synthetic peptide
QYPMW

SEQ ID NO: 4146 - protein, 17 aa, Artificial Sequence
  Description of Artificial Sequence: Synthetic peptide
VIYPSGGFTSYADSVKG

SEQ ID NO: 4147 - protein, 15 aa, Artificial Sequence
  Description of Artificial Sequence: Synthetic peptide
DRAYGDYVGWNGFDY

SEQ ID NO: 4148 - protein, 11 aa, Artificial Sequence
  Description of Artificial Sequence: Synthetic peptide
RASQSISSFLA

SEQ ID NO: 4149 - protein, 7 aa, Artificial Sequence
  Description of Artificial Sequence: Synthetic peptide
DASYRAT

SEQ ID NO: 4150 - protein, 9 aa, Artificial Sequence
  Description of Artificial Sequence: Synthetic peptide
QQRGNWPIT

SEQ ID NO: 4151 - protein, 5 aa, Artificial Sequence
  Description of Artificial Sequence: Synthetic peptide
QYPMW

SEQ ID NO: 4152 - protein, 17 aa, Artificial Sequence
  Description of Artificial Sequence: Synthetic peptide
VIYPSGGYTGYADSVKG

SEQ ID NO: 4153 - protein, 15 aa, Artificial Sequence
  Description of Artificial Sequence: Synthetic peptide
DRAYGDYVGWNGFDY

SEQ ID NO: 4154 - protein, 11 aa, Artificial Sequence
  Description of Artificial Sequence: Synthetic peptide
RASQSISSFLA

SEQ ID NO: 4155 - protein, 7 aa, Artificial Sequence
  Description of Artificial Sequence: Synthetic peptide
DASYRAT

SEQ ID NO: 4156 - protein, 9 aa, Artificial Sequence
  Description of Artificial Sequence: Synthetic peptide
QQRGNWPIT

SEQ ID NO: 4157 - protein, 5 aa, Artificial Sequence
  Description of Artificial Sequence: Synthetic peptide
QYQMW

SEQ ID NO: 4158 - protein, 17 aa, Artificial Sequence
  Description of Artificial Sequence: Synthetic peptide
VIYPSGGATYYADSVKG

SEQ ID NO: 4159 - protein, 15 aa, Artificial Sequence
  Description of Artificial Sequence: Synthetic peptide
DRAYGDYVGWNGFDY

SEQ ID NO: 4160 - protein, 11 aa, Artificial Sequence
  Description of Artificial Sequence: Synthetic peptide
RASQSISSFLA

SEQ ID NO: 4161 - protein, 7 aa, Artificial Sequence
  Description of Artificial Sequence: Synthetic peptide
DASYRAT

SEQ ID NO: 4162 - protein, 9 aa, Artificial Sequence
  Description of Artificial Sequence: Synthetic peptide
QQRGNWPIT

SEQ ID NO: 4163 - protein, 5 aa, Artificial Sequence
  Description of Artificial Sequence: Synthetic peptide
QYSMI

SEQ ID NO: 4164 - protein, 17 aa, Artificial Sequence
  Description of Artificial Sequence: Synthetic peptide
YIVPSGGYTSYADSVKG

SEQ ID NO: 4165 - protein, 15 aa, Artificial Sequence
  Description of Artificial Sequence: Synthetic peptide
DRAYGDYVGWNGFDY

SEQ ID NO: 4166 - protein, 11 aa, Artificial Sequence
  Description of Artificial Sequence: Synthetic peptide
RASQSISSFLA

SEQ ID NO: 4167 - protein, 7 aa, Artificial Sequence
  Description of Artificial Sequence: Synthetic peptide
DASYRAT

SEQ ID NO: 4168 - protein, 9 aa, Artificial Sequence
  Description of Artificial Sequence: Synthetic peptide
QQRGNWPIT

SEQ ID NO: 4169 - protein, 5 aa, Artificial Sequence
  Description of Artificial Sequence: Synthetic peptide
QYSMW

SEQ ID NO: 4170 - protein, 17 aa, Artificial Sequence
  Description of Artificial Sequence: Synthetic peptide
SIVPSGGATFYADSVKG

SEQ ID NO: 4171 - protein, 15 aa, Artificial Sequence
  Description of Artificial Sequence: Synthetic peptide
DRAYGDYVGWNGFDY

SEQ ID NO: 4172 - protein, 11 aa, Artificial Sequence
  Description of Artificial Sequence: Synthetic peptide
RASQSISSFLA

SEQ ID NO: 4173 - protein, 7 aa, Artificial Sequence
  Description of Artificial Sequence: Synthetic peptide
DASYRAT

SEQ ID NO: 4174 - protein, 9 aa, Artificial Sequence
  Description of Artificial Sequence: Synthetic peptide
QQRGNWPIT

SEQ ID NO: 4175 - protein, 5 aa, Artificial Sequence
  Description of Artificial Sequence: Synthetic peptide
QYSMW

SEQ ID NO: 4176 - protein, 17 aa, Artificial Sequence
  Description of Artificial Sequence: Synthetic peptide
VIYSSGGATFYADSVKG

SEQ ID NO: 4177 - protein, 15 aa, Artificial Sequence
  Description of Artificial Sequence: Synthetic peptide
DRAYGDYVGWNGFDY

SEQ ID NO: 4178 - protein, 11 aa, Artificial Sequence
  Description of Artificial Sequence: Synthetic peptide
RASQSISSFLA

SEQ ID NO: 4179 - protein, 7 aa, Artificial Sequence
  Description of Artificial Sequence: Synthetic peptide
DASYRAT

SEQ ID NO: 4180 - protein, 9 aa, Artificial Sequence
  Description of Artificial Sequence: Synthetic peptide
QQRGNWPIT

SEQ ID NO: 4181 - protein, 5 aa, Artificial Sequence
  Description of Artificial Sequence: Synthetic peptide
QYSMW

SEQ ID NO: 4182 - protein, 17 aa, Artificial Sequence
  Description of Artificial Sequence: Synthetic peptide
VIYSSGSATFYADSVKG

SEQ ID NO: 4183 - protein, 15 aa, Artificial Sequence
  Description of Artificial Sequence: Synthetic peptide
DRAYGDYVGWNGFDY

SEQ ID NO: 4184 - protein, 11 aa, Artificial Sequence
  Description of Artificial Sequence: Synthetic peptide
RASQSISSFLA

SEQ ID NO: 4185 - protein, 7 aa, Artificial Sequence
  Description of Artificial Sequence: Synthetic peptide
DASYRAT

SEQ ID NO: 4186 - protein, 9 aa, Artificial Sequence
  Description of Artificial Sequence: Synthetic peptide
QQRGNWPIT

SEQ ID NO: 4187 - protein, 5 aa, Artificial Sequence
  Description of Artificial Sequence: Synthetic peptide
QYWMW

SEQ ID NO: 4188 - protein, 17 aa, Artificial Sequence
  Description of Artificial Sequence: Synthetic peptide
VISSSGGGTYYADSVKG

SEQ ID NO: 4189 - protein, 15 aa, Artificial Sequence
  Description of Artificial Sequence: Synthetic peptide
DRAYGDYVGWNGFDY

SEQ ID NO: 4190 - protein, 11 aa, Artificial Sequence
  Description of Artificial Sequence: Synthetic peptide
RASQSISSFLA

SEQ ID NO: 4191 - protein, 7 aa, Artificial Sequence
  Description of Artificial Sequence: Synthetic peptide
DASYRAT

SEQ ID NO: 4192 - protein, 9 aa, Artificial Sequence
  Description of Artificial Sequence: Synthetic peptide
QQRGNWPIT

SEQ ID NO: 4193 - protein, 5 aa, Artificial Sequence
  Description of Artificial Sequence: Synthetic peptide
QYWMW

SEQ ID NO: 4194 - protein, 17 aa, Artificial Sequence
  Description of Artificial Sequence: Synthetic peptide
VIVPSGGKTFYADSVKG

SEQ ID NO: 4195 - protein, 15 aa, Artificial Sequence
  Description of Artificial Sequence: Synthetic peptide
DRAYGDYVGWNGFDY

SEQ ID NO: 4196 - protein, 11 aa, Artificial Sequence
  Description of Artificial Sequence: Synthetic peptide
RASQSISSFLA

SEQ ID NO: 4197 - protein, 7 aa, Artificial Sequence
  Description of Artificial Sequence: Synthetic peptide
DASYRAT

SEQ ID NO: 4198 - protein, 9 aa, Artificial Sequence
  Description of Artificial Sequence: Synthetic peptide
QQRGNWPIT

SEQ ID NO: 4199 - protein, 5 aa, Artificial Sequence
  Description of Artificial Sequence: Synthetic peptide
RYAMI

SEQ ID NO: 4200 - protein, 17 aa, Artificial Sequence
  Description of Artificial Sequence: Synthetic peptide
YISPSGGFTDYADSVKG

SEQ ID NO: 4201 - protein, 15 aa, Artificial Sequence
  Description of Artificial Sequence: Synthetic peptide
DRAYGDYVGWNGFDY

SEQ ID NO: 4202 - protein, 11 aa, Artificial Sequence
  Description of Artificial Sequence: Synthetic peptide
RASQSISSFLA

SEQ ID NO: 4203 - protein, 7 aa, Artificial Sequence
  Description of Artificial Sequence: Synthetic peptide
DASYRAT

SEQ ID NO: 4204 - protein, 9 aa, Artificial Sequence
  Description of Artificial Sequence: Synthetic peptide
QQRGNWPIT

SEQ ID NO: 4205 - protein, 5 aa, Artificial Sequence
  Description of Artificial Sequence: Synthetic peptide
RYAMM

SEQ ID NO: 4206 - protein, 17 aa, Artificial Sequence
  Description of Artificial Sequence: Synthetic peptide
YISPSGGFTDYADSVKG

SEQ ID NO: 4207 - protein, 15 aa, Artificial Sequence
  Description of Artificial Sequence: Synthetic peptide
DRAYGDYVGWNGFDY

SEQ ID NO: 4208 - protein, 11 aa, Artificial Sequence
  Description of Artificial Sequence: Synthetic peptide
RASQSISSFLA

SEQ ID NO: 4209 - protein, 7 aa, Artificial Sequence
  Description of Artificial Sequence: Synthetic peptide
DASYRAT

SEQ ID NO: 4210 - protein, 9 aa, Artificial Sequence
  Description of Artificial Sequence: Synthetic peptide
QQRGNWPIT

SEQ ID NO: 4211 - protein, 5 aa, Artificial Sequence
  Description of Artificial Sequence: Synthetic peptide
RYAMW

SEQ ID NO: 4212 - protein, 17 aa, Artificial Sequence
  Description of Artificial Sequence: Synthetic peptide
SIYPSGGGTFYADSVKG

SEQ ID NO: 4213 - protein, 15 aa, Artificial Sequence
  Description of Artificial Sequence: Synthetic peptide
DRAYGDYVGWNGFDY

SEQ ID NO: 4214 - protein, 11 aa, Artificial Sequence
  Description of Artificial Sequence: Synthetic peptide
RASQSISSFLA

SEQ ID NO: 4215 - protein, 7 aa, Artificial Sequence
  Description of Artificial Sequence: Synthetic peptide
DASYRAT

SEQ ID NO: 4216 - protein, 9 aa, Artificial Sequence
  Description of Artificial Sequence: Synthetic peptide
QQRGNWPIT

SEQ ID NO: 4217 - protein, 5 aa, Artificial Sequence
  Description of Artificial Sequence: Synthetic peptide
RYAMW

SEQ ID NO: 4218 - protein, 17 aa, Artificial Sequence
  Description of Artificial Sequence: Synthetic peptide
YIVPSGGYTDYADSVKG

SEQ ID NO: 4219 - protein, 15 aa, Artificial Sequence
  Description of Artificial Sequence: Synthetic peptide
DRAYGDYVGWNGFDY

SEQ ID NO: 4220 - protein, 11 aa, Artificial Sequence
  Description of Artificial Sequence: Synthetic peptide
RASQSISSFLA

SEQ ID NO: 4221 - protein, 7 aa, Artificial Sequence
  Description of Artificial Sequence: Synthetic peptide
DASYRAT

SEQ ID NO: 4222 - protein, 9 aa, Artificial Sequence
  Description of Artificial Sequence: Synthetic peptide
QQRGNWPIT

SEQ ID NO: 4223 - protein, 5 aa, Artificial Sequence
  Description of Artificial Sequence: Synthetic peptide
RYDMF

SEQ ID NO: 4224 - protein, 17 aa, Artificial Sequence
  Description of Artificial Sequence: Synthetic peptide
SISPSGGGTYYADSVKG

SEQ ID NO: 4225 - protein, 15 aa, Artificial Sequence
  Description of Artificial Sequence: Synthetic peptide
DRAYGDYVGWNGFDY

SEQ ID NO: 4226 - protein, 11 aa, Artificial Sequence
  Description of Artificial Sequence: Synthetic peptide
RASQSISSFLA

SEQ ID NO: 4227 - protein, 7 aa, Artificial Sequence
  Description of Artificial Sequence: Synthetic peptide
DASYRAT

SEQ ID NO: 4228 - protein, 9 aa, Artificial Sequence
  Description of Artificial Sequence: Synthetic peptide
QQRGNWPIT

SEQ ID NO: 4229 - protein, 5 aa, Artificial Sequence
  Description of Artificial Sequence: Synthetic peptide
RYDMW

SEQ ID NO: 4230 - protein, 17 aa, Artificial Sequence
  Description of Artificial Sequence: Synthetic peptide
SISSSGGFTGYADSVKG

SEQ ID NO: 4231 - protein, 15 aa, Artificial Sequence
  Description of Artificial Sequence: Synthetic peptide
DRAYGDYVGWNGFDY

SEQ ID NO: 4232 - protein, 11 aa, Artificial Sequence
  Description of Artificial Sequence: Synthetic peptide
RASQSISSFLA

SEQ ID NO: 4233 - protein, 7 aa, Artificial Sequence
  Description of Artificial Sequence: Synthetic peptide
DASYRAT

SEQ ID NO: 4234 - protein, 9 aa, Artificial Sequence
  Description of Artificial Sequence: Synthetic peptide
QQRGNWPIT

SEQ ID NO: 4235 - protein, 5 aa, Artificial Sequence
  Description of Artificial Sequence: Synthetic peptide
RYDMW

SEQ ID NO: 4236 - protein, 17 aa, Artificial Sequence
  Description of Artificial Sequence: Synthetic peptide
VISPSGGATFYADSVKG

SEQ ID NO: 4237 - protein, 15 aa, Artificial Sequence
  Description of Artificial Sequence: Synthetic peptide
DRAYGDYVGWNGFDY

SEQ ID NO: 4238 - protein, 11 aa, Artificial Sequence
  Description of Artificial Sequence: Synthetic peptide
RASQSISSFLA

SEQ ID NO: 4239 - protein, 7 aa, Artificial Sequence
  Description of Artificial Sequence: Synthetic peptide
DASYRAT

SEQ ID NO: 4240 - protein, 9 aa, Artificial Sequence
  Description of Artificial Sequence: Synthetic peptide
QQRGNWPIT

SEQ ID NO: 4241 - protein, 5 aa, Artificial Sequence
  Description of Artificial Sequence: Synthetic peptide
RYDMW

SEQ ID NO: 4242 - protein, 17 aa, Artificial Sequence
  Description of Artificial Sequence: Synthetic peptide
VIYPSGGHTMYADSVKG

SEQ ID NO: 4243 - protein, 15 aa, Artificial Sequence
  Description of Artificial Sequence: Synthetic peptide
DRAYGDYVGWNGFDY

SEQ ID NO: 4244 - protein, 11 aa, Artificial Sequence
  Description of Artificial Sequence: Synthetic peptide
RASQSISSFLA

SEQ ID NO: 4245 - protein, 7 aa, Artificial Sequence
  Description of Artificial Sequence: Synthetic peptide
DASYRAT

SEQ ID NO: 4246 - protein, 9 aa, Artificial Sequence
  Description of Artificial Sequence: Synthetic peptide
QQRGNWPIT

SEQ ID NO: 4247 - protein, 5 aa, Artificial Sequence
  Description of Artificial Sequence: Synthetic peptide
RYDMW

SEQ ID NO: 4248 - protein, 17 aa, Artificial Sequence
  Description of Artificial Sequence: Synthetic peptide
WISPSGGGTQYADSVKG

SEQ ID NO: 4249 - protein, 15 aa, Artificial Sequence
  Description of Artificial Sequence: Synthetic peptide
DRAYGDYVGWNGFDY

SEQ ID NO: 4250 - protein, 11 aa, Artificial Sequence
  Description of Artificial Sequence: Synthetic peptide
RASQSISSFLA

SEQ ID NO: 4251 - protein, 7 aa, Artificial Sequence
  Description of Artificial Sequence: Synthetic peptide
DASYRAT

SEQ ID NO: 4252 - protein, 9 aa, Artificial Sequence
  Description of Artificial Sequence: Synthetic peptide
QQRGNWPIT

SEQ ID NO: 4253 - protein, 5 aa, Artificial Sequence
  Description of Artificial Sequence: Synthetic peptide
RYDMW

SEQ ID NO: 4254 - protein, 17 aa, Artificial Sequence
  Description of Artificial Sequence: Synthetic peptide
YIVPSGGFTSYADSVKG

SEQ ID NO: 4255 - protein, 15 aa, Artificial Sequence
  Description of Artificial Sequence: Synthetic peptide
DRAYGDYVGWNGFDY

SEQ ID NO: 4256 - protein, 11 aa, Artificial Sequence
  Description of Artificial Sequence: Synthetic peptide
RASQSISSFLA

SEQ ID NO: 4257 - protein, 7 aa, Artificial Sequence
  Description of Artificial Sequence: Synthetic peptide
DASYRAT

SEQ ID NO: 4258 - protein, 9 aa, Artificial Sequence
  Description of Artificial Sequence: Synthetic peptide
QQRGNWPIT

SEQ ID NO: 4259 - protein, 5 aa, Artificial Sequence
  Description of Artificial Sequence: Synthetic peptide
RYHMW

SEQ ID NO: 4260 - protein, 17 aa, Artificial Sequence
  Description of Artificial Sequence: Synthetic peptide
YISPSGGSTLYADSVKG

SEQ ID NO: 4261 - protein, 15 aa, Artificial Sequence
  Description of Artificial Sequence: Synthetic peptide
DRAYGDYVGWNGFDY

SEQ ID NO: 4262 - protein, 11 aa, Artificial Sequence
  Description of Artificial Sequence: Synthetic peptide
RASQSISSFLA

SEQ ID NO: 4263 - protein, 7 aa, Artificial Sequence
  Description of Artificial Sequence: Synthetic peptide
DASYRAT

SEQ ID NO: 4264 - protein, 9 aa, Artificial Sequence
  Description of Artificial Sequence: Synthetic peptide
QQRGNWPIT

SEQ ID NO: 4265 - protein, 5 aa, Artificial Sequence
  Description of Artificial Sequence: Synthetic peptide
RYMMI

SEQ ID NO: 4266 - protein, 17 aa, Artificial Sequence
  Description of Artificial Sequence: Synthetic peptide
GIYPSGGWTDYADSVKG

SEQ ID NO: 4267 - protein, 15 aa, Artificial Sequence
  Description of Artificial Sequence: Synthetic peptide
DRAYGDYVGWNGFDY

SEQ ID NO: 4268 - protein, 11 aa, Artificial Sequence
  Description of Artificial Sequence: Synthetic peptide
RASQSISSFLA

SEQ ID NO: 4269 - protein, 7 aa, Artificial Sequence
  Description of Artificial Sequence: Synthetic peptide
DASYRAT

SEQ ID NO: 4270 - protein, 9 aa, Artificial Sequence
  Description of Artificial Sequence: Synthetic peptide
QQRGNWPIT

SEQ ID NO: 4271 - protein, 5 aa, Artificial Sequence
  Description of Artificial Sequence: Synthetic peptide
RYNMW

SEQ ID NO: 4272 - protein, 17 aa, Artificial Sequence
  Description of Artificial Sequence: Synthetic peptide
VIYPSGGATYYADSVKG

SEQ ID NO: 4273 - protein, 15 aa, Artificial Sequence
  Description of Artificial Sequence: Synthetic peptide
DRAYGDYVGWNGFDY

SEQ ID NO: 4274 - protein, 11 aa, Artificial Sequence
  Description of Artificial Sequence: Synthetic peptide
RASQSISSFLA

SEQ ID NO: 4275 - protein, 7 aa, Artificial Sequence
  Description of Artificial Sequence: Synthetic peptide
DASYRAT

SEQ ID NO: 4276 - protein, 9 aa, Artificial Sequence
  Description of Artificial Sequence: Synthetic peptide
QQRGNWPIT

SEQ ID NO: 4277 - protein, 5 aa, Artificial Sequence
  Description of Artificial Sequence: Synthetic peptide
RYPMF

SEQ ID NO: 4278 - protein, 17 aa, Artificial Sequence
  Description of Artificial Sequence: Synthetic peptide
YISPSGGYTSYADSVKG

SEQ ID NO: 4279 - protein, 15 aa, Artificial Sequence
  Description of Artificial Sequence: Synthetic peptide
DRAYGDYVGWNGFDY

SEQ ID NO: 4280 - protein, 11 aa, Artificial Sequence
  Description of Artificial Sequence: Synthetic peptide
RASQSISSFLA

SEQ ID NO: 4281 - protein, 7 aa, Artificial Sequence
  Description of Artificial Sequence: Synthetic peptide
DASYRAT

SEQ ID NO: 4282 - protein, 9 aa, Artificial Sequence
  Description of Artificial Sequence: Synthetic peptide
QQRGNWPIT

SEQ ID NO: 4283 - protein, 5 aa, Artificial Sequence
  Description of Artificial Sequence: Synthetic peptide
RYPMF

SEQ ID NO: 4284 - protein, 17 aa, Artificial Sequence
  Description of Artificial Sequence: Synthetic peptide
YIVPSGGYTDYADSVKG

SEQ ID NO: 4285 - protein, 15 aa, Artificial Sequence
  Description of Artificial Sequence: Synthetic peptide
DRAYGDYVGWNGFDY

SEQ ID NO: 4286 - protein, 11 aa, Artificial Sequence
  Description of Artificial Sequence: Synthetic peptide
RASQSISSFLA

SEQ ID NO: 4287 - protein, 7 aa, Artificial Sequence
  Description of Artificial Sequence: Synthetic peptide
DASYRAT

SEQ ID NO: 4288 - protein, 9 aa, Artificial Sequence
  Description of Artificial Sequence: Synthetic peptide
QQRGNWPIT

SEQ ID NO: 4289 - protein, 5 aa, Artificial Sequence
  Description of Artificial Sequence: Synthetic peptide
RYPMI

SEQ ID NO: 4290 - protein, 17 aa, Artificial Sequence
  Description of Artificial Sequence: Synthetic peptide
YIYPSGGGTYYADSVKG

SEQ ID NO: 4291 - protein, 15 aa, Artificial Sequence
  Description of Artificial Sequence: Synthetic peptide
DRAYGDYVGWNGFDY

SEQ ID NO: 4292 - protein, 11 aa, Artificial Sequence
  Description of Artificial Sequence: Synthetic peptide
RASQSISSFLA

SEQ ID NO: 4293 - protein, 7 aa, Artificial Sequence
  Description of Artificial Sequence: Synthetic peptide
DASYRAT

SEQ ID NO: 4294 - protein, 9 aa, Artificial Sequence
  Description of Artificial Sequence: Synthetic peptide
QQRGNWPIT

SEQ ID NO: 4295 - protein, 5 aa, Artificial Sequence
  Description of Artificial Sequence: Synthetic peptide
RYPMV

SEQ ID NO: 4296 - protein, 17 aa, Artificial Sequence
  Description of Artificial Sequence: Synthetic peptide
YISPSGGYTGYADSVKG

SEQ ID NO: 4297 - protein, 15 aa, Artificial Sequence
  Description of Artificial Sequence: Synthetic peptide
DRAYGDYVGWNGFDY

SEQ ID NO: 4298 - protein, 11 aa, Artificial Sequence
  Description of Artificial Sequence: Synthetic peptide
RASQSISSFLA

SEQ ID NO: 4299 - protein, 7 aa, Artificial Sequence
  Description of Artificial Sequence: Synthetic peptide
DASYRAT

SEQ ID NO: 4300 - protein, 9 aa, Artificial Sequence
  Description of Artificial Sequence: Synthetic peptide
QQRGNWPIT

SEQ ID NO: 4301 - protein, 5 aa, Artificial Sequence
  Description of Artificial Sequence: Synthetic peptide
RYPMW

SEQ ID NO: 4302 - protein, 17 aa, Artificial Sequence
  Description of Artificial Sequence: Synthetic peptide
SISSSGGGTYYADSVKG

SEQ ID NO: 4303 - protein, 15 aa, Artificial Sequence
  Description of Artificial Sequence: Synthetic peptide
DRAYGDYVGWNGFDY

SEQ ID NO: 4304 - protein, 11 aa, Artificial Sequence
  Description of Artificial Sequence: Synthetic peptide
RASQSISSFLA

SEQ ID NO: 4305 - protein, 7 aa, Artificial Sequence
  Description of Artificial Sequence: Synthetic peptide
DASYRAT

SEQ ID NO: 4306 - protein, 9 aa, Artificial Sequence
  Description of Artificial Sequence: Synthetic peptide
QQRGNWPIT

SEQ ID NO: 4307 - protein, 5 aa, Artificial Sequence
  Description of Artificial Sequence: Synthetic peptide
RYPMW

SEQ ID NO: 4308 - protein, 17 aa, Artificial Sequence
  Description of Artificial Sequence: Synthetic peptide
SIYPSGGATFYADSVKG

SEQ ID NO: 4309 - protein, 15 aa, Artificial Sequence
  Description of Artificial Sequence: Synthetic peptide
DRAYGDYVGWNGFDY

SEQ ID NO: 4310 - protein, 11 aa, Artificial Sequence
  Description of Artificial Sequence: Synthetic peptide
RASQSISSFLA

SEQ ID NO: 4311 - protein, 7 aa, Artificial Sequence
  Description of Artificial Sequence: Synthetic peptide
DASYRAT

SEQ ID NO: 4312 - protein, 9 aa, Artificial Sequence
  Description of Artificial Sequence: Synthetic peptide
QQRGNWPIT

SEQ ID NO: 4313 - protein, 5 aa, Artificial Sequence
  Description of Artificial Sequence: Synthetic peptide
RYPMW

SEQ ID NO: 4314 - protein, 17 aa, Artificial Sequence
  Description of Artificial Sequence: Synthetic peptide
VIYPSGGATYYADSVKG

SEQ ID NO: 4315 - protein, 15 aa, Artificial Sequence
  Description of Artificial Sequence: Synthetic peptide
DRAYGDYVGWNGFDY

SEQ ID NO: 4316 - protein, 11 aa, Artificial Sequence
  Description of Artificial Sequence: Synthetic peptide
RASQSISSFLA

SEQ ID NO: 4317 - protein, 7 aa, Artificial Sequence
  Description of Artificial Sequence: Synthetic peptide
DASYRAT

SEQ ID NO: 4318 - protein, 9 aa, Artificial Sequence
  Description of Artificial Sequence: Synthetic peptide
QQRGNWPIT

SEQ ID NO: 4319 - protein, 5 aa, Artificial Sequence
  Description of Artificial Sequence: Synthetic peptide
RYPMW

SEQ ID NO: 4320 - protein, 17 aa, Artificial Sequence
  Description of Artificial Sequence: Synthetic peptide
VIYPSGGTTFYADSVKG

SEQ ID NO: 4321 - protein, 15 aa, Artificial Sequence
  Description of Artificial Sequence: Synthetic peptide
DRAYGDYVGWNGFDY

SEQ ID NO: 4322 - protein, 11 aa, Artificial Sequence
  Description of Artificial Sequence: Synthetic peptide
RASQSISSFLA

SEQ ID NO: 4323 - protein, 7 aa, Artificial Sequence
  Description of Artificial Sequence: Synthetic peptide
DASYRAT

SEQ ID NO: 4324 - protein, 9 aa, Artificial Sequence
  Description of Artificial Sequence: Synthetic peptide
QQRGNWPIT

SEQ ID NO: 4325 - protein, 5 aa, Artificial Sequence
  Description of Artificial Sequence: Synthetic peptide
RYPMW

SEQ ID NO: 4326 - protein, 17 aa, Artificial Sequence
  Description of Artificial Sequence: Synthetic peptide
VIYSSGGYTGYADSVKG

SEQ ID NO: 4327 - protein, 15 aa, Artificial Sequence
  Description of Artificial Sequence: Synthetic peptide
DRAYGDYVGWNGFDY

SEQ ID NO: 4328 - protein, 11 aa, Artificial Sequence
  Description of Artificial Sequence: Synthetic peptide
RASQSISSFLA

SEQ ID NO: 4329 - protein, 7 aa, Artificial Sequence
  Description of Artificial Sequence: Synthetic peptide
DASYRAT

SEQ ID NO: 4330 - protein, 9 aa, Artificial Sequence
  Description of Artificial Sequence: Synthetic peptide
QQRGNWPIT

SEQ ID NO: 4331 - protein, 5 aa, Artificial Sequence
  Description of Artificial Sequence: Synthetic peptide
RYPMW

SEQ ID NO: 4332 - protein, 17 aa, Artificial Sequence
  Description of Artificial Sequence: Synthetic peptide
YIGSSGGGTFYADSVKG

SEQ ID NO: 4333 - protein, 15 aa, Artificial Sequence
  Description of Artificial Sequence: Synthetic peptide
DRAYGDYVGWNGFDY

SEQ ID NO: 4334 - protein, 11 aa, Artificial Sequence
  Description of Artificial Sequence: Synthetic peptide
RASQSISSFLA

SEQ ID NO: 4335 - protein, 7 aa, Artificial Sequence
  Description of Artificial Sequence: Synthetic peptide
DASYRAT

SEQ ID NO: 4336 - protein, 9 aa, Artificial Sequence
  Description of Artificial Sequence: Synthetic peptide
QQRGNWPIT

SEQ ID NO: 4337 - protein, 5 aa, Artificial Sequence
  Description of Artificial Sequence: Synthetic peptide
RYPMW

SEQ ID NO: 4338 - protein, 17 aa, Artificial Sequence
  Description of Artificial Sequence: Synthetic peptide
YISPSGGGTLYADSVKG

SEQ ID NO: 4339 - protein, 15 aa, Artificial Sequence
  Description of Artificial Sequence: Synthetic peptide
DRAYGDYVGWNGFDY

SEQ ID NO: 4340 - protein, 11 aa, Artificial Sequence
  Description of Artificial Sequence: Synthetic peptide
RASQSISSFLA

SEQ ID NO: 4341 - protein, 7 aa, Artificial Sequence
  Description of Artificial Sequence: Synthetic peptide
DASYRAT

SEQ ID NO: 4342 - protein, 9 aa, Artificial Sequence
  Description of Artificial Sequence: Synthetic peptide
QQRGNWPIT

SEQ ID NO: 4343 - protein, 5 aa, Artificial Sequence
  Description of Artificial Sequence: Synthetic peptide
RYPMW

SEQ ID NO: 4344 - protein, 17 aa, Artificial Sequence
  Description of Artificial Sequence: Synthetic peptide
YISPSGGMTSYADSVKG

SEQ ID NO: 4345 - protein, 15 aa, Artificial Sequence
  Description of Artificial Sequence: Synthetic peptide
DRAYGDYVGWNGFDY

SEQ ID NO: 4346 - protein, 11 aa, Artificial Sequence
  Description of Artificial Sequence: Synthetic peptide
RASQSISSFLA

SEQ ID NO: 4347 - protein, 7 aa, Artificial Sequence
  Description of Artificial Sequence: Synthetic peptide
DASYRAT

SEQ ID NO: 4348 - protein, 9 aa, Artificial Sequence
  Description of Artificial Sequence: Synthetic peptide
QQRGNWPIT

SEQ ID NO: 4349 - protein, 5 aa, Artificial Sequence
  Description of Artificial Sequence: Synthetic peptide
RYPMW

SEQ ID NO: 4350 - protein, 17 aa, Artificial Sequence
  Description of Artificial Sequence: Synthetic peptide
YISSSGGGTFYADSVKG

SEQ ID NO: 4351 - protein, 15 aa, Artificial Sequence
  Description of Artificial Sequence: Synthetic peptide
DRAYGDYVGWNGFDY

SEQ ID NO: 4352 - protein, 11 aa, Artificial Sequence
  Description of Artificial Sequence: Synthetic peptide
RASQSISSFLA

SEQ ID NO: 4353 - protein, 7 aa, Artificial Sequence
  Description of Artificial Sequence: Synthetic peptide
DASYRAT

SEQ ID NO: 4354 - protein, 9 aa, Artificial Sequence
  Description of Artificial Sequence: Synthetic peptide
QQRGNWPIT

SEQ ID NO: 4355 - protein, 5 aa, Artificial Sequence
  Description of Artificial Sequence: Synthetic peptide
RYPMW

SEQ ID NO: 4356 - protein, 17 aa, Artificial Sequence
  Description of Artificial Sequence: Synthetic peptide
YISSSGGGTLYADSVKG

SEQ ID NO: 4357 - protein, 15 aa, Artificial Sequence
  Description of Artificial Sequence: Synthetic peptide
DRAYGDYVGWNGFDY

SEQ ID NO: 4358 - protein, 11 aa, Artificial Sequence
  Description of Artificial Sequence: Synthetic peptide
RASQSISSFLA

SEQ ID NO: 4359 - protein, 7 aa, Artificial Sequence
  Description of Artificial Sequence: Synthetic peptide
DASYRAT

SEQ ID NO: 4360 - protein, 9 aa, Artificial Sequence
  Description of Artificial Sequence: Synthetic peptide
QQRGNWPIT

SEQ ID NO: 4361 - protein, 5 aa, Artificial Sequence
  Description of Artificial Sequence: Synthetic peptide
RYPMW

SEQ ID NO: 4362 - protein, 17 aa, Artificial Sequence
  Description of Artificial Sequence: Synthetic peptide
YIVPSGGATYYADSVKG

SEQ ID NO: 4363 - protein, 15 aa, Artificial Sequence
  Description of Artificial Sequence: Synthetic peptide
DRAYGDYVGWNGFDY

SEQ ID NO: 4364 - protein, 11 aa, Artificial Sequence
  Description of Artificial Sequence: Synthetic peptide
RASQSISSFLA

SEQ ID NO: 4365 - protein, 7 aa, Artificial Sequence
  Description of Artificial Sequence: Synthetic peptide
DASYRAT

SEQ ID NO: 4366 - protein, 9 aa, Artificial Sequence
  Description of Artificial Sequence: Synthetic peptide
QQRGNWPIT

SEQ ID NO: 4367 - protein, 5 aa, Artificial Sequence
  Description of Artificial Sequence: Synthetic peptide
RYPMW

SEQ ID NO: 4368 - protein, 17 aa, Artificial Sequence
  Description of Artificial Sequence: Synthetic peptide
YIVPSGGFTDYAHSVKG

SEQ ID NO: 4369 - protein, 15 aa, Artificial Sequence
  Description of Artificial Sequence: Synthetic peptide
DRAYGDYVGWNGFDY

SEQ ID NO: 4370 - protein, 11 aa, Artificial Sequence
  Description of Artificial Sequence: Synthetic peptide
RASQSISSFLA

SEQ ID NO: 4371 - protein, 7 aa, Artificial Sequence
  Description of Artificial Sequence: Synthetic peptide
DASYRAT

SEQ ID NO: 4372 - protein, 9 aa, Artificial Sequence
  Description of Artificial Sequence: Synthetic peptide
QQRGNWPIT

SEQ ID NO: 4373 - protein, 5 aa, Artificial Sequence
  Description of Artificial Sequence: Synthetic peptide
RYPMW

SEQ ID NO: 4374 - protein, 17 aa, Artificial Sequence
  Description of Artificial Sequence: Synthetic peptide
YIVPSGGTTYYADSVKG

SEQ ID NO: 4375 - protein, 15 aa, Artificial Sequence
  Description of Artificial Sequence: Synthetic peptide
DRAYGDYVGWNGFDY

SEQ ID NO: 4376 - protein, 11 aa, Artificial Sequence
  Description of Artificial Sequence: Synthetic peptide
RASQSISSFLA

SEQ ID NO: 4377 - protein, 7 aa, Artificial Sequence
  Description of Artificial Sequence: Synthetic peptide
DASYRAT

SEQ ID NO: 4378 - protein, 9 aa, Artificial Sequence
  Description of Artificial Sequence: Synthetic peptide
QQRGNWPIT

SEQ ID NO: 4379 - protein, 5 aa, Artificial Sequence
  Description of Artificial Sequence: Synthetic peptide
RYPMW

SEQ ID NO: 4380 - protein, 17 aa, Artificial Sequence
  Description of Artificial Sequence: Synthetic peptide
YIYPSGGATFYADSVKG

SEQ ID NO: 4381 - protein, 15 aa, Artificial Sequence
  Description of Artificial Sequence: Synthetic peptide
DRAYGDYVGWNGFDY

SEQ ID NO: 4382 - protein, 11 aa, Artificial Sequence
  Description of Artificial Sequence: Synthetic peptide
RASQSISSFLA

SEQ ID NO: 4383 - protein, 7 aa, Artificial Sequence
  Description of Artificial Sequence: Synthetic peptide
DASYRAT

SEQ ID NO: 4384 - protein, 9 aa, Artificial Sequence
  Description of Artificial Sequence: Synthetic peptide
QQRGNWPIT

SEQ ID NO: 4385 - protein, 5 aa, Artificial Sequence
  Description of Artificial Sequence: Synthetic peptide
RYPMW

SEQ ID NO: 4386 - protein, 17 aa, Artificial Sequence
  Description of Artificial Sequence: Synthetic peptide
YIYSSGGKTFYADSVKG

SEQ ID NO: 4387 - protein, 15 aa, Artificial Sequence
  Description of Artificial Sequence: Synthetic peptide
DRAYGDYVGWNGFDY

SEQ ID NO: 4388 - protein, 11 aa, Artificial Sequence
  Description of Artificial Sequence: Synthetic peptide
RASQSISSFLA

SEQ ID NO: 4389 - protein, 7 aa, Artificial Sequence
  Description of Artificial Sequence: Synthetic peptide
DASYRAT

SEQ ID NO: 4390 - protein, 9 aa, Artificial Sequence
  Description of Artificial Sequence: Synthetic peptide
QQRGNWPIT

SEQ ID NO: 4391 - protein, 5 aa, Artificial Sequence
  Description of Artificial Sequence: Synthetic peptide
RYSMW

SEQ ID NO: 4392 - protein, 17 aa, Artificial Sequence
  Description of Artificial Sequence: Synthetic peptide
SIYPSGGATFYADSVKG

SEQ ID NO: 4393 - protein, 15 aa, Artificial Sequence
  Description of Artificial Sequence: Synthetic peptide
DRAYGDYVGWNGFDY

SEQ ID NO: 4394 - protein, 11 aa, Artificial Sequence
  Description of Artificial Sequence: Synthetic peptide
RASQSISSFLA

SEQ ID NO: 4395 - protein, 7 aa, Artificial Sequence
  Description of Artificial Sequence: Synthetic peptide
DASYRAT

SEQ ID NO: 4396 - protein, 9 aa, Artificial Sequence
  Description of Artificial Sequence: Synthetic peptide
QQRGNWPIT

SEQ ID NO: 4397 - protein, 5 aa, Artificial Sequence
  Description of Artificial Sequence: Synthetic peptide
RYSMW

SEQ ID NO: 4398 - protein, 17 aa, Artificial Sequence
  Description of Artificial Sequence: Synthetic peptide
VIYPSGGYTGYADSVKG

SEQ ID NO: 4399 - protein, 15 aa, Artificial Sequence
  Description of Artificial Sequence: Synthetic peptide
DRAYGDYVGWNGFDY

SEQ ID NO: 4400 - protein, 11 aa, Artificial Sequence
  Description of Artificial Sequence: Synthetic peptide
RASQSISSFLA

SEQ ID NO: 4401 - protein, 7 aa, Artificial Sequence
  Description of Artificial Sequence: Synthetic peptide
DASYRAT

SEQ ID NO: 4402 - protein, 9 aa, Artificial Sequence
  Description of Artificial Sequence: Synthetic peptide
QQRGNWPIT

SEQ ID NO: 4403 - protein, 5 aa, Artificial Sequence
  Description of Artificial Sequence: Synthetic peptide
RYWMW

SEQ ID NO: 4404 - protein, 17 aa, Artificial Sequence
  Description of Artificial Sequence: Synthetic peptide
VIVPSGGATFYADSVKG

SEQ ID NO: 4405 - protein, 15 aa, Artificial Sequence
  Description of Artificial Sequence: Synthetic peptide
DRAYGDYVGWNGFDY

SEQ ID NO: 4406 - protein, 11 aa, Artificial Sequence
  Description of Artificial Sequence: Synthetic peptide
RASQSISSFLA

SEQ ID NO: 4407 - protein, 7 aa, Artificial Sequence
  Description of Artificial Sequence: Synthetic peptide
DASYRAT

SEQ ID NO: 4408 - protein, 9 aa, Artificial Sequence
  Description of Artificial Sequence: Synthetic peptide
QQRGNWPIT

SEQ ID NO: 4409 - protein, 5 aa, Artificial Sequence
  Description of Artificial Sequence: Synthetic peptide
RYYMM

SEQ ID NO: 4410 - protein, 17 aa, Artificial Sequence
  Description of Artificial Sequence: Synthetic peptide
YISPSGGATYYADSVKG

SEQ ID NO: 4411 - protein, 15 aa, Artificial Sequence
  Description of Artificial Sequence: Synthetic peptide
DRAYGDYVGWNGFDY

SEQ ID NO: 4412 - protein, 11 aa, Artificial Sequence
  Description of Artificial Sequence: Synthetic peptide
RASQSISSFLA

SEQ ID NO: 4413 - protein, 7 aa, Artificial Sequence
  Description of Artificial Sequence: Synthetic peptide
DASYRAT

SEQ ID NO: 4414 - protein, 9 aa, Artificial Sequence
  Description of Artificial Sequence: Synthetic peptide
QQRGNWPIT

SEQ ID NO: 4415 - protein, 5 aa, Artificial Sequence
  Description of Artificial Sequence: Synthetic peptide
SYDMI

SEQ ID NO: 4416 - protein, 17 aa, Artificial Sequence
  Description of Artificial Sequence: Synthetic peptide
WIGPSGGSTMYADSVKG

SEQ ID NO: 4417 - protein, 15 aa, Artificial Sequence
  Description of Artificial Sequence: Synthetic peptide
DRAYGDYVGWNGFDY

SEQ ID NO: 4418 - protein, 11 aa, Artificial Sequence
  Description of Artificial Sequence: Synthetic peptide
RASQSISSFLA

SEQ ID NO: 4419 - protein, 7 aa, Artificial Sequence
  Description of Artificial Sequence: Synthetic peptide
DASYRAT

SEQ ID NO: 4420 - protein, 9 aa, Artificial Sequence
  Description of Artificial Sequence: Synthetic peptide
QQRGNWPIT

SEQ ID NO: 4421 - protein, 5 aa, Artificial Sequence
  Description of Artificial Sequence: Synthetic peptide
SYDMW

SEQ ID NO: 4422 - protein, 17 aa, Artificial Sequence
  Description of Artificial Sequence: Synthetic peptide
SISSSVGATYYADSVKG

SEQ ID NO: 4423 - protein, 15 aa, Artificial Sequence
  Description of Artificial Sequence: Synthetic peptide
DRAYGDYVGWNGFDY

SEQ ID NO: 4424 - protein, 11 aa, Artificial Sequence
  Description of Artificial Sequence: Synthetic peptide
RASQSISSFLA

SEQ ID NO: 4425 - protein, 7 aa, Artificial Sequence
  Description of Artificial Sequence: Synthetic peptide
DASYRAT

SEQ ID NO: 4426 - protein, 9 aa, Artificial Sequence
  Description of Artificial Sequence: Synthetic peptide
QQRGNWPIT

SEQ ID NO: 4427 - protein, 5 aa, Artificial Sequence
  Description of Artificial Sequence: Synthetic peptide
SYDMW

SEQ ID NO: 4428 - protein, 17 aa, Artificial Sequence
  Description of Artificial Sequence: Synthetic peptide
VIGPSGGGTFYADSVKG

SEQ ID NO: 4429 - protein, 15 aa, Artificial Sequence
  Description of Artificial Sequence: Synthetic peptide
DRAYGDYVGWNGFDY

SEQ ID NO: 4430 - protein, 11 aa, Artificial Sequence
  Description of Artificial Sequence: Synthetic peptide
RASQSISSFLA

SEQ ID NO: 4431 - protein, 7 aa, Artificial Sequence
  Description of Artificial Sequence: Synthetic peptide
DASYRAT

SEQ ID NO: 4432 - protein, 9 aa, Artificial Sequence
  Description of Artificial Sequence: Synthetic peptide
QQRGNWPIT

SEQ ID NO: 4433 - protein, 5 aa, Artificial Sequence
  Description of Artificial Sequence: Synthetic peptide
SYDMW

SEQ ID NO: 4434 - protein, 17 aa, Artificial Sequence
  Description of Artificial Sequence: Synthetic peptide
VISPSGGYTGYADSVKG

SEQ ID NO: 4435 - protein, 15 aa, Artificial Sequence
  Description of Artificial Sequence: Synthetic peptide
DRAYGDYVGWNGFDY

SEQ ID NO: 4436 - protein, 11 aa, Artificial Sequence
  Description of Artificial Sequence: Synthetic peptide
RASQSISSFLA

SEQ ID NO: 4437 - protein, 7 aa, Artificial Sequence
  Description of Artificial Sequence: Synthetic peptide
DASYRAT

SEQ ID NO: 4438 - protein, 9 aa, Artificial Sequence
  Description of Artificial Sequence: Synthetic peptide
QQRGNWPIT

SEQ ID NO: 4439 - protein, 5 aa, Artificial Sequence
  Description of Artificial Sequence: Synthetic peptide
SYDMW

SEQ ID NO: 4440 - protein, 17 aa, Artificial Sequence
  Description of Artificial Sequence: Synthetic peptide
VIYPSGGRTYYADSVKG

SEQ ID NO: 4441 - protein, 15 aa, Artificial Sequence
  Description of Artificial Sequence: Synthetic peptide
DRAYGDYVGWNGFDY

SEQ ID NO: 4442 - protein, 11 aa, Artificial Sequence
  Description of Artificial Sequence: Synthetic peptide
RASQSISSFLA

SEQ ID NO: 4443 - protein, 7 aa, Artificial Sequence
  Description of Artificial Sequence: Synthetic peptide
DASYRAT

SEQ ID NO: 4444 - protein, 9 aa, Artificial Sequence
  Description of Artificial Sequence: Synthetic peptide
QQRGNWPIT

SEQ ID NO: 4445 - protein, 5 aa, Artificial Sequence
  Description of Artificial Sequence: Synthetic peptide
SYDMW

SEQ ID NO: 4446 - protein, 17 aa, Artificial Sequence
  Description of Artificial Sequence: Synthetic peptide
VIYSSGGFTGYADSVKG

SEQ ID NO: 4447 - protein, 15 aa, Artificial Sequence
  Description of Artificial Sequence: Synthetic peptide
DRAYGDYVGWNGFDY

SEQ ID NO: 4448 - protein, 11 aa, Artificial Sequence
  Description of Artificial Sequence: Synthetic peptide
RASQSISSFLA

SEQ ID NO: 4449 - protein, 7 aa, Artificial Sequence
  Description of Artificial Sequence: Synthetic peptide
DASYRAT

SEQ ID NO: 4450 - protein, 9 aa, Artificial Sequence
  Description of Artificial Sequence: Synthetic peptide
QQRGNWPIT

SEQ ID NO: 4451 - protein, 5 aa, Artificial Sequence
  Description of Artificial Sequence: Synthetic peptide
SYDMW

SEQ ID NO: 4452 - protein, 17 aa, Artificial Sequence
  Description of Artificial Sequence: Synthetic peptide
VIYSSGGTTFYADSVKG

SEQ ID NO: 4453 - protein, 15 aa, Artificial Sequence
  Description of Artificial Sequence: Synthetic peptide
DRAYGDYVGWNGFDY

SEQ ID NO: 4454 - protein, 11 aa, Artificial Sequence
  Description of Artificial Sequence: Synthetic peptide
RASQSISSFLA

SEQ ID NO: 4455 - protein, 7 aa, Artificial Sequence
  Description of Artificial Sequence: Synthetic peptide
DASYRAT

SEQ ID NO: 4456 - protein, 9 aa, Artificial Sequence
  Description of Artificial Sequence: Synthetic peptide
QQRGNWPIT

SEQ ID NO: 4457 - protein, 5 aa, Artificial Sequence
  Description of Artificial Sequence: Synthetic peptide
SYDMW

SEQ ID NO: 4458 - protein, 17 aa, Artificial Sequence
  Description of Artificial Sequence: Synthetic peptide
VIYSSGGYTGYADSVKG

SEQ ID NO: 4459 - protein, 15 aa, Artificial Sequence
  Description of Artificial Sequence: Synthetic peptide
DRAYGDYVGWNGFDY

SEQ ID NO: 4460 - protein, 11 aa, Artificial Sequence
  Description of Artificial Sequence: Synthetic peptide
RASQSISSFLA

SEQ ID NO: 4461 - protein, 7 aa, Artificial Sequence
  Description of Artificial Sequence: Synthetic peptide
DASYRAT

SEQ ID NO: 4462 - protein, 9 aa, Artificial Sequence
  Description of Artificial Sequence: Synthetic peptide
QQRGNWPIT

SEQ ID NO: 4463 - protein, 5 aa, Artificial Sequence
  Description of Artificial Sequence: Synthetic peptide
SYEMW

SEQ ID NO: 4464 - protein, 17 aa, Artificial Sequence
  Description of Artificial Sequence: Synthetic peptide
VIYSSGGATFYADSVKG

SEQ ID NO: 4465 - protein, 15 aa, Artificial Sequence
  Description of Artificial Sequence: Synthetic peptide
DRAYGDYVGWNGFDY

SEQ ID NO: 4466 - protein, 11 aa, Artificial Sequence
  Description of Artificial Sequence: Synthetic peptide
RASQSISSFLA

SEQ ID NO: 4467 - protein, 7 aa, Artificial Sequence
  Description of Artificial Sequence: Synthetic peptide
DASYRAT

SEQ ID NO: 4468 - protein, 9 aa, Artificial Sequence
  Description of Artificial Sequence: Synthetic peptide
QQRGNWPIT

SEQ ID NO: 4469 - protein, 5 aa, Artificial Sequence
  Description of Artificial Sequence: Synthetic peptide
SYEMW

SEQ ID NO: 4470 - protein, 17 aa, Artificial Sequence
  Description of Artificial Sequence: Synthetic peptide
YISSSGGGTYYADSVKG

SEQ ID NO: 4471 - protein, 15 aa, Artificial Sequence
  Description of Artificial Sequence: Synthetic peptide
DRAYGDYVGWNGFDY

SEQ ID NO: 4472 - protein, 11 aa, Artificial Sequence
  Description of Artificial Sequence: Synthetic peptide
RASQSISSFLA

SEQ ID NO: 4473 - protein, 7 aa, Artificial Sequence
  Description of Artificial Sequence: Synthetic peptide
DASYRAT

SEQ ID NO: 4474 - protein, 9 aa, Artificial Sequence
  Description of Artificial Sequence: Synthetic peptide
QQRGNWPIT

SEQ ID NO: 4475 - protein, 5 aa, Artificial Sequence
  Description of Artificial Sequence: Synthetic peptide
SYMMI

SEQ ID NO: 4476 - protein, 17 aa, Artificial Sequence
  Description of Artificial Sequence: Synthetic peptide
SISPSGGGTYYADSVKG

SEQ ID NO: 4477 - protein, 15 aa, Artificial Sequence
  Description of Artificial Sequence: Synthetic peptide
DRAYGDYVGWNGFDY

SEQ ID NO: 4478 - protein, 11 aa, Artificial Sequence
  Description of Artificial Sequence: Synthetic peptide
RASQSISSFLA

SEQ ID NO: 4479 - protein, 7 aa, Artificial Sequence
  Description of Artificial Sequence: Synthetic peptide
DASYRAT

SEQ ID NO: 4480 - protein, 9 aa, Artificial Sequence
  Description of Artificial Sequence: Synthetic peptide
QQRGNWPIT

SEQ ID NO: 4481 - protein, 5 aa, Artificial Sequence
  Description of Artificial Sequence: Synthetic peptide
SYMMI

SEQ ID NO: 4482 - protein, 17 aa, Artificial Sequence
  Description of Artificial Sequence: Synthetic peptide
SISPSGGWTSYADSVKG

SEQ ID NO: 4483 - protein, 15 aa, Artificial Sequence
  Description of Artificial Sequence: Synthetic peptide
DRAYGDYVGWNGFDY

SEQ ID NO: 4484 - protein, 11 aa, Artificial Sequence
  Description of Artificial Sequence: Synthetic peptide
RASQSISSFLA

SEQ ID NO: 4485 - protein, 7 aa, Artificial Sequence
  Description of Artificial Sequence: Synthetic peptide
DASYRAT

SEQ ID NO: 4486 - protein, 9 aa, Artificial Sequence
  Description of Artificial Sequence: Synthetic peptide
QQRGNWPIT

SEQ ID NO: 4487 - protein, 5 aa, Artificial Sequence
  Description of Artificial Sequence: Synthetic peptide
SYMMI

SEQ ID NO: 4488 - protein, 17 aa, Artificial Sequence
  Description of Artificial Sequence: Synthetic peptide
SIYPSGGYTSYADSVKG

SEQ ID NO: 4489 - protein, 15 aa, Artificial Sequence
  Description of Artificial Sequence: Synthetic peptide
DRAYGDYVGWNGFDY

SEQ ID NO: 4490 - protein, 11 aa, Artificial Sequence
  Description of Artificial Sequence: Synthetic peptide
RASQSISSFLA

SEQ ID NO: 4491 - protein, 7 aa, Artificial Sequence
  Description of Artificial Sequence: Synthetic peptide
DASYRAT

SEQ ID NO: 4492 - protein, 9 aa, Artificial Sequence
  Description of Artificial Sequence: Synthetic peptide
QQRGNWPIT

SEQ ID NO: 4493 - protein, 5 aa, Artificial Sequence
  Description of Artificial Sequence: Synthetic peptide
SYNMW

SEQ ID NO: 4494 - protein, 17 aa, Artificial Sequence
  Description of Artificial Sequence: Synthetic peptide
SISPSGGGTYYADSVKG

SEQ ID NO: 4495 - protein, 15 aa, Artificial Sequence
  Description of Artificial Sequence: Synthetic peptide
DRAYGDYVGWNGFDY

SEQ ID NO: 4496 - protein, 11 aa, Artificial Sequence
  Description of Artificial Sequence: Synthetic peptide
RASQSISSFLA

SEQ ID NO: 4497 - protein, 7 aa, Artificial Sequence
  Description of Artificial Sequence: Synthetic peptide
DASYRAT

SEQ ID NO: 4498 - protein, 9 aa, Artificial Sequence
  Description of Artificial Sequence: Synthetic peptide
QQRGNWPIT

SEQ ID NO: 4499 - protein, 5 aa, Artificial Sequence
  Description of Artificial Sequence: Synthetic peptide
SYPMI

SEQ ID NO: 4500 - protein, 17 aa, Artificial Sequence
  Description of Artificial Sequence: Synthetic peptide
YISSSGGFTDYADSVKG

SEQ ID NO: 4501 - protein, 15 aa, Artificial Sequence
  Description of Artificial Sequence: Synthetic peptide
DRAYGDYVGWNGFDY

SEQ ID NO: 4502 - protein, 11 aa, Artificial Sequence
  Description of Artificial Sequence: Synthetic peptide
RASQSISSFLA

SEQ ID NO: 4503 - protein, 7 aa, Artificial Sequence
  Description of Artificial Sequence: Synthetic peptide
DASYRAT

SEQ ID NO: 4504 - protein, 9 aa, Artificial Sequence
  Description of Artificial Sequence: Synthetic peptide
QQRGNWPIT

SEQ ID NO: 4505 - protein, 5 aa, Artificial Sequence
  Description of Artificial Sequence: Synthetic peptide
SYPMM

SEQ ID NO: 4506 - protein, 17 aa, Artificial Sequence
  Description of Artificial Sequence: Synthetic peptide
YIYSSGGGTFYADSVKG

SEQ ID NO: 4507 - protein, 15 aa, Artificial Sequence
  Description of Artificial Sequence: Synthetic peptide
DRAYGDYVGWNGFDY

SEQ ID NO: 4508 - protein, 11 aa, Artificial Sequence
  Description of Artificial Sequence: Synthetic peptide
RASQSISSFLA

SEQ ID NO: 4509 - protein, 7 aa, Artificial Sequence
  Description of Artificial Sequence: Synthetic peptide
DASYRAT

SEQ ID NO: 4510 - protein, 9 aa, Artificial Sequence
  Description of Artificial Sequence: Synthetic peptide
QQRGNWPIT

SEQ ID NO: 4511 - protein, 5 aa, Artificial Sequence
  Description of Artificial Sequence: Synthetic peptide
SYPMW

SEQ ID NO: 4512 - protein, 17 aa, Artificial Sequence
  Description of Artificial Sequence: Synthetic peptide
SISPSGGGTYYADSVKG

SEQ ID NO: 4513 - protein, 15 aa, Artificial Sequence
  Description of Artificial Sequence: Synthetic peptide
DRAYGDYVGWNGFDY

SEQ ID NO: 4514 - protein, 11 aa, Artificial Sequence
  Description of Artificial Sequence: Synthetic peptide
RASQSISSFLA

SEQ ID NO: 4515 - protein, 7 aa, Artificial Sequence
  Description of Artificial Sequence: Synthetic peptide
DASYRAT

SEQ ID NO: 4516 - protein, 9 aa, Artificial Sequence
  Description of Artificial Sequence: Synthetic peptide
QQRGNWPIT

SEQ ID NO: 4517 - protein, 5 aa, Artificial Sequence
  Description of Artificial Sequence: Synthetic peptide
SYPMW

SEQ ID NO: 4518 - protein, 16 aa, Artificial Sequence
  Description of Artificial Sequence: Synthetic peptide
SISPSGMTYYADSVKG

SEQ ID NO: 4519 - protein, 15 aa, Artificial Sequence
  Description of Artificial Sequence: Synthetic peptide
DRAYGDYVGWNGFDY

SEQ ID NO: 4520 - protein, 11 aa, Artificial Sequence
  Description of Artificial Sequence: Synthetic peptide
RASQSISSFLA

SEQ ID NO: 4521 - protein, 7 aa, Artificial Sequence
  Description of Artificial Sequence: Synthetic peptide
DASYRAT

SEQ ID NO: 4522 - protein, 9 aa, Artificial Sequence
  Description of Artificial Sequence: Synthetic peptide
QQRGNWPIT

SEQ ID NO: 4523 - protein, 5 aa, Artificial Sequence
  Description of Artificial Sequence: Synthetic peptide
SYPMW

SEQ ID NO: 4524 - protein, 17 aa, Artificial Sequence
  Description of Artificial Sequence: Synthetic peptide
SIYPSGGGTFYADSVKG

SEQ ID NO: 4525 - protein, 15 aa, Artificial Sequence
  Description of Artificial Sequence: Synthetic peptide
DRAYGDYVGWNGFDY

SEQ ID NO: 4526 - protein, 11 aa, Artificial Sequence
  Description of Artificial Sequence: Synthetic peptide
RASQSISSFLA

SEQ ID NO: 4527 - protein, 7 aa, Artificial Sequence
  Description of Artificial Sequence: Synthetic peptide
DASYRAT

SEQ ID NO: 4528 - protein, 9 aa, Artificial Sequence
  Description of Artificial Sequence: Synthetic peptide
QQRGNWPIT

SEQ ID NO: 4529 - protein, 5 aa, Artificial Sequence
  Description of Artificial Sequence: Synthetic peptide
SYPMW

SEQ ID NO: 4530 - protein, 17 aa, Artificial Sequence
  Description of Artificial Sequence: Synthetic peptide
YISSSGGGTYYADSVKG

SEQ ID NO: 4531 - protein, 15 aa, Artificial Sequence
  Description of Artificial Sequence: Synthetic peptide
DRAYGDYVGWNGFDY

SEQ ID NO: 4532 - protein, 11 aa, Artificial Sequence
  Description of Artificial Sequence: Synthetic peptide
RASQSISSFLA

SEQ ID NO: 4533 - protein, 7 aa, Artificial Sequence
  Description of Artificial Sequence: Synthetic peptide
DASYRAT

SEQ ID NO: 4534 - protein, 9 aa, Artificial Sequence
  Description of Artificial Sequence: Synthetic peptide
QQRGNWPIT

SEQ ID NO: 4535 - protein, 5 aa, Artificial Sequence
  Description of Artificial Sequence: Synthetic peptide
SYPMW

SEQ ID NO: 4536 - protein, 17 aa, Artificial Sequence
  Description of Artificial Sequence: Synthetic peptide
YIVPSGGATFYADSVKG

SEQ ID NO: 4537 - protein, 15 aa, Artificial Sequence
  Description of Artificial Sequence: Synthetic peptide
DRAYGDYVGWNGFDY

SEQ ID NO: 4538 - protein, 11 aa, Artificial Sequence
  Description of Artificial Sequence: Synthetic peptide
RASQSISSFLA

SEQ ID NO: 4539 - protein, 7 aa, Artificial Sequence
  Description of Artificial Sequence: Synthetic peptide
DASYRAT

SEQ ID NO: 4540 - protein, 9 aa, Artificial Sequence
  Description of Artificial Sequence: Synthetic peptide
QQRGNWPIT

SEQ ID NO: 4541 - protein, 5 aa, Artificial Sequence
  Description of Artificial Sequence: Synthetic peptide
SYPMW

SEQ ID NO: 4542 - protein, 17 aa, Artificial Sequence
  Description of Artificial Sequence: Synthetic peptide
YIVPSGGSTLYADSVKG

SEQ ID NO: 4543 - protein, 15 aa, Artificial Sequence
  Description of Artificial Sequence: Synthetic peptide
DRAYGDYVGWNGFDY

SEQ ID NO: 4544 - protein, 11 aa, Artificial Sequence
  Description of Artificial Sequence: Synthetic peptide
RASQSISSFLA

SEQ ID NO: 4545 - protein, 7 aa, Artificial Sequence
  Description of Artificial Sequence: Synthetic peptide
DASYRAT

SEQ ID NO: 4546 - protein, 9 aa, Artificial Sequence
  Description of Artificial Sequence: Synthetic peptide
QQRGNWPIT

SEQ ID NO: 4547 - protein, 5 aa, Artificial Sequence
  Description of Artificial Sequence: Synthetic peptide
SYPMW

SEQ ID NO: 4548 - protein, 17 aa, Artificial Sequence
  Description of Artificial Sequence: Synthetic peptide
YIVPSGGYTYYADSVKG

SEQ ID NO: 4549 - protein, 15 aa, Artificial Sequence
  Description of Artificial Sequence: Synthetic peptide
DRAYGDYVGWNGFDY

SEQ ID NO: 4550 - protein, 11 aa, Artificial Sequence
  Description of Artificial Sequence: Synthetic peptide
RASQSISSFLA

SEQ ID NO: 4551 - protein, 7 aa, Artificial Sequence
  Description of Artificial Sequence: Synthetic peptide
DASYRAT

SEQ ID NO: 4552 - protein, 9 aa, Artificial Sequence
  Description of Artificial Sequence: Synthetic peptide
QQRGNWPIT

SEQ ID NO: 4553 - protein, 5 aa, Artificial Sequence
  Description of Artificial Sequence: Synthetic peptide
SYQMW

SEQ ID NO: 4554 - protein, 17 aa, Artificial Sequence
  Description of Artificial Sequence: Synthetic peptide
SIYPSGGATFYADSVKG

SEQ ID NO: 4555 - protein, 15 aa, Artificial Sequence
  Description of Artificial Sequence: Synthetic peptide
DRAYGDYVGWNGFDY

SEQ ID NO: 4556 - protein, 11 aa, Artificial Sequence
  Description of Artificial Sequence: Synthetic peptide
RASQSISSFLA

SEQ ID NO: 4557 - protein, 7 aa, Artificial Sequence
  Description of Artificial Sequence: Synthetic peptide
DASYRAT

SEQ ID NO: 4558 - protein, 9 aa, Artificial Sequence
  Description of Artificial Sequence: Synthetic peptide
QQRGNWPIT

SEQ ID NO: 4559 - protein, 5 aa, Artificial Sequence
  Description of Artificial Sequence: Synthetic peptide
SYSMW

SEQ ID NO: 4560 - protein, 17 aa, Artificial Sequence
  Description of Artificial Sequence: Synthetic peptide
VIYSSGGYTGYADSVKG

SEQ ID NO: 4561 - protein, 15 aa, Artificial Sequence
  Description of Artificial Sequence: Synthetic peptide
DRAYGDYVGWNGFDY

SEQ ID NO: 4562 - protein, 11 aa, Artificial Sequence
  Description of Artificial Sequence: Synthetic peptide
RASQSISSFLA

SEQ ID NO: 4563 - protein, 7 aa, Artificial Sequence
  Description of Artificial Sequence: Synthetic peptide
DASYRAT

SEQ ID NO: 4564 - protein, 9 aa, Artificial Sequence
  Description of Artificial Sequence: Synthetic peptide
QQRGNWPIT

SEQ ID NO: 4565 - protein, 5 aa, Artificial Sequence
  Description of Artificial Sequence: Synthetic peptide
TYAMI

SEQ ID NO: 4566 - protein, 17 aa, Artificial Sequence
  Description of Artificial Sequence: Synthetic peptide
YIGPSGGFTDYADSVKG

SEQ ID NO: 4567 - protein, 15 aa, Artificial Sequence
  Description of Artificial Sequence: Synthetic peptide
DRAYGDYVGWNGFDY

SEQ ID NO: 4568 - protein, 11 aa, Artificial Sequence
  Description of Artificial Sequence: Synthetic peptide
RASQSISSFLA

SEQ ID NO: 4569 - protein, 7 aa, Artificial Sequence
  Description of Artificial Sequence: Synthetic peptide
DASYRAT

SEQ ID NO: 4570 - protein, 9 aa, Artificial Sequence
  Description of Artificial Sequence: Synthetic peptide
QQRGNWPIT

SEQ ID NO: 4571 - protein, 5 aa, Artificial Sequence
  Description of Artificial Sequence: Synthetic peptide
TYAMW

SEQ ID NO: 4572 - protein, 17 aa, Artificial Sequence
  Description of Artificial Sequence: Synthetic peptide
YISPSGGGTFYADSVKG

SEQ ID NO: 4573 - protein, 15 aa, Artificial Sequence
  Description of Artificial Sequence: Synthetic peptide
DRAYGDYVGWNGFDY

SEQ ID NO: 4574 - protein, 11 aa, Artificial Sequence
  Description of Artificial Sequence: Synthetic peptide
RASQSISSFLA

SEQ ID NO: 4575 - protein, 7 aa, Artificial Sequence
  Description of Artificial Sequence: Synthetic peptide
DASYRAT

SEQ ID NO: 4576 - protein, 9 aa, Artificial Sequence
  Description of Artificial Sequence: Synthetic peptide
QQRGNWPIT

SEQ ID NO: 4577 - protein, 5 aa, Artificial Sequence
  Description of Artificial Sequence: Synthetic peptide
TYDMF

SEQ ID NO: 4578 - protein, 17 aa, Artificial Sequence
  Description of Artificial Sequence: Synthetic peptide
SISSSGGATFYADSVKG

SEQ ID NO: 4579 - protein, 15 aa, Artificial Sequence
  Description of Artificial Sequence: Synthetic peptide
DRAYGDYVGWNGFDY

SEQ ID NO: 4580 - protein, 11 aa, Artificial Sequence
  Description of Artificial Sequence: Synthetic peptide
RASQSISSFLA

SEQ ID NO: 4581 - protein, 7 aa, Artificial Sequence
  Description of Artificial Sequence: Synthetic peptide
DASYRAT

SEQ ID NO: 4582 - protein, 9 aa, Artificial Sequence
  Description of Artificial Sequence: Synthetic peptide
QQRGNWPIT

SEQ ID NO: 4583 - protein, 5 aa, Artificial Sequence
  Description of Artificial Sequence: Synthetic peptide
TYDMI

SEQ ID NO: 4584 - protein, 17 aa, Artificial Sequence
  Description of Artificial Sequence: Synthetic peptide
YISPSGGYTGYADSVKG

SEQ ID NO: 4585 - protein, 15 aa, Artificial Sequence
  Description of Artificial Sequence: Synthetic peptide
DRAYGDYVGWNGFDY

SEQ ID NO: 4586 - protein, 11 aa, Artificial Sequence
  Description of Artificial Sequence: Synthetic peptide
RASQSISSFLA

SEQ ID NO: 4587 - protein, 7 aa, Artificial Sequence
  Description of Artificial Sequence: Synthetic peptide
DASYRAT

SEQ ID NO: 4588 - protein, 9 aa, Artificial Sequence
  Description of Artificial Sequence: Synthetic peptide
QQRGNWPIT

SEQ ID NO: 4589 - protein, 5 aa, Artificial Sequence
  Description of Artificial Sequence: Synthetic peptide
TYDMI

SEQ ID NO: 4590 - protein, 17 aa, Artificial Sequence
  Description of Artificial Sequence: Synthetic peptide
YISSSGGFTDYADSVKG

SEQ ID NO: 4591 - protein, 15 aa, Artificial Sequence
  Description of Artificial Sequence: Synthetic peptide
DRAYGDYVGWNGFDY

SEQ ID NO: 4592 - protein, 11 aa, Artificial Sequence
  Description of Artificial Sequence: Synthetic peptide
RASQSISSFLA

SEQ ID NO: 4593 - protein, 7 aa, Artificial Sequence
  Description of Artificial Sequence: Synthetic peptide
DASYRAT

SEQ ID NO: 4594 - protein, 9 aa, Artificial Sequence
  Description of Artificial Sequence: Synthetic peptide
QQRGNWPIT

SEQ ID NO: 4595 - protein, 5 aa, Artificial Sequence
  Description of Artificial Sequence: Synthetic peptide
TYDMW

SEQ ID NO: 4596 - protein, 17 aa, Artificial Sequence
  Description of Artificial Sequence: Synthetic peptide
VIYPSGGPTYYADSVKG

SEQ ID NO: 4597 - protein, 15 aa, Artificial Sequence
  Description of Artificial Sequence: Synthetic peptide
DRAYGDYVGWNGFDY

SEQ ID NO: 4598 - protein, 11 aa, Artificial Sequence
  Description of Artificial Sequence: Synthetic peptide
RASQSISSFLA

SEQ ID NO: 4599 - protein, 7 aa, Artificial Sequence
  Description of Artificial Sequence: Synthetic peptide
DASYRAT

SEQ ID NO: 4600 - protein, 9 aa, Artificial Sequence
  Description of Artificial Sequence: Synthetic peptide
QQRGNWPIT

SEQ ID NO: 4601 - protein, 5 aa, Artificial Sequence
  Description of Artificial Sequence: Synthetic peptide
TYDMW

SEQ ID NO: 4602 - protein, 17 aa, Artificial Sequence
  Description of Artificial Sequence: Synthetic peptide
YISSSGGGTFYADSVKG

SEQ ID NO: 4603 - protein, 15 aa, Artificial Sequence
  Description of Artificial Sequence: Synthetic peptide
DRAYGDYVGWNGFDY

SEQ ID NO: 4604 - protein, 11 aa, Artificial Sequence
  Description of Artificial Sequence: Synthetic peptide
RASQSISSFLA

SEQ ID NO: 4605 - protein, 7 aa, Artificial Sequence
  Description of Artificial Sequence: Synthetic peptide
DASYRAT

SEQ ID NO: 4606 - protein, 9 aa, Artificial Sequence
  Description of Artificial Sequence: Synthetic peptide
QQRGNWPIT

SEQ ID NO: 4607 - protein, 5 aa, Artificial Sequence
  Description of Artificial Sequence: Synthetic peptide
TYEMW

SEQ ID NO: 4608 - protein, 17 aa, Artificial Sequence
  Description of Artificial Sequence: Synthetic peptide
YISSSGGGTGYADSVKG

SEQ ID NO: 4609 - protein, 15 aa, Artificial Sequence
  Description of Artificial Sequence: Synthetic peptide
DRAYGDYVGWNGFDY

SEQ ID NO: 4610 - protein, 11 aa, Artificial Sequence
  Description of Artificial Sequence: Synthetic peptide
RASQSISSFLA

SEQ ID NO: 4611 - protein, 7 aa, Artificial Sequence
  Description of Artificial Sequence: Synthetic peptide
DASYRAT

SEQ ID NO: 4612 - protein, 9 aa, Artificial Sequence
  Description of Artificial Sequence: Synthetic peptide
QQRGNWPIT

SEQ ID NO: 4613 - protein, 5 aa, Artificial Sequence
  Description of Artificial Sequence: Synthetic peptide
TYPMF

SEQ ID NO: 4614 - protein, 17 aa, Artificial Sequence
  Description of Artificial Sequence: Synthetic peptide
YISPSGGYTDYADSVKG

SEQ ID NO: 4615 - protein, 15 aa, Artificial Sequence
  Description of Artificial Sequence: Synthetic peptide
DRAYGDYVGWNGFDY

SEQ ID NO: 4616 - protein, 11 aa, Artificial Sequence
  Description of Artificial Sequence: Synthetic peptide
RASQSISSFLA

SEQ ID NO: 4617 - protein, 7 aa, Artificial Sequence
  Description of Artificial Sequence: Synthetic peptide
DASYRAT

SEQ ID NO: 4618 - protein, 9 aa, Artificial Sequence
  Description of Artificial Sequence: Synthetic peptide
QQRGNWPIT

SEQ ID NO: 4619 - protein, 5 aa, Artificial Sequence
  Description of Artificial Sequence: Synthetic peptide
TYPMI

SEQ ID NO: 4620 - protein, 17 aa, Artificial Sequence
  Description of Artificial Sequence: Synthetic peptide
YIVPSGGYTGYADSVKG

SEQ ID NO: 4621 - protein, 15 aa, Artificial Sequence
  Description of Artificial Sequence: Synthetic peptide
DRAYGDYVGWNGFDY

SEQ ID NO: 4622 - protein, 11 aa, Artificial Sequence
  Description of Artificial Sequence: Synthetic peptide
RASQSISSFLA

SEQ ID NO: 4623 - protein, 7 aa, Artificial Sequence
  Description of Artificial Sequence: Synthetic peptide
DASYRAT

SEQ ID NO: 4624 - protein, 9 aa, Artificial Sequence
  Description of Artificial Sequence: Synthetic peptide
QQRGNWPIT

SEQ ID NO: 4625 - protein, 5 aa, Artificial Sequence
  Description of Artificial Sequence: Synthetic peptide
TYPMM

SEQ ID NO: 4626 - protein, 17 aa, Artificial Sequence
  Description of Artificial Sequence: Synthetic peptide
YIYPSGGATFYADSVKG

SEQ ID NO: 4627 - protein, 15 aa, Artificial Sequence
  Description of Artificial Sequence: Synthetic peptide
DRAYGDYVGWNGFDY

SEQ ID NO: 4628 - protein, 11 aa, Artificial Sequence
  Description of Artificial Sequence: Synthetic peptide
RASQSISSFLA

SEQ ID NO: 4629 - protein, 7 aa, Artificial Sequence
  Description of Artificial Sequence: Synthetic peptide
DASYRAT

SEQ ID NO: 4630 - protein, 9 aa, Artificial Sequence
  Description of Artificial Sequence: Synthetic peptide
QQRGNWPIT

SEQ ID NO: 4631 - protein, 5 aa, Artificial Sequence
  Description of Artificial Sequence: Synthetic peptide
TYPMW

SEQ ID NO: 4632 - protein, 17 aa, Artificial Sequence
  Description of Artificial Sequence: Synthetic peptide
SISPSGGATYYADSVKG

SEQ ID NO: 4633 - protein, 15 aa, Artificial Sequence
  Description of Artificial Sequence: Synthetic peptide
DRAYGDYVGWNGFDY

SEQ ID NO: 4634 - protein, 11 aa, Artificial Sequence
  Description of Artificial Sequence: Synthetic peptide
RASQSISSFLA

SEQ ID NO: 4635 - protein, 7 aa, Artificial Sequence
  Description of Artificial Sequence: Synthetic peptide
DASYRAT

SEQ ID NO: 4636 - protein, 9 aa, Artificial Sequence
  Description of Artificial Sequence: Synthetic peptide
QQRGNWPIT

SEQ ID NO: 4637 - protein, 5 aa, Artificial Sequence
  Description of Artificial Sequence: Synthetic peptide
TYPMW

SEQ ID NO: 4638 - protein, 17 aa, Artificial Sequence
  Description of Artificial Sequence: Synthetic peptide
SIVPSGGATYYADSVKG

SEQ ID NO: 4639 - protein, 15 aa, Artificial Sequence
  Description of Artificial Sequence: Synthetic peptide
DRAYGDYVGWNGFDY

SEQ ID NO: 4640 - protein, 11 aa, Artificial Sequence
  Description of Artificial Sequence: Synthetic peptide
RASQSISSFLA

SEQ ID NO: 4641 - protein, 7 aa, Artificial Sequence
  Description of Artificial Sequence: Synthetic peptide
DASYRAT

SEQ ID NO: 4642 - protein, 9 aa, Artificial Sequence
  Description of Artificial Sequence: Synthetic peptide
QQRGNWPIT

SEQ ID NO: 4643 - protein, 5 aa, Artificial Sequence
  Description of Artificial Sequence: Synthetic peptide
TYPMW

SEQ ID NO: 4644 - protein, 17 aa, Artificial Sequence
  Description of Artificial Sequence: Synthetic peptide
VIYSSGGYTGYADSVKG

SEQ ID NO: 4645 - protein, 15 aa, Artificial Sequence
  Description of Artificial Sequence: Synthetic peptide
DRAYGDYVGWNGFDY

SEQ ID NO: 4646 - protein, 11 aa, Artificial Sequence
  Description of Artificial Sequence: Synthetic peptide
RASQSISSFLA

SEQ ID NO: 4647 - protein, 7 aa, Artificial Sequence
  Description of Artificial Sequence: Synthetic peptide
DASYRAT

SEQ ID NO: 4648 - protein, 9 aa, Artificial Sequence
  Description of Artificial Sequence: Synthetic peptide
QQRGNWPIT

SEQ ID NO: 4649 - protein, 5 aa, Artificial Sequence
  Description of Artificial Sequence: Synthetic peptide
TYPMW

SEQ ID NO: 4650 - protein, 17 aa, Artificial Sequence
  Description of Artificial Sequence: Synthetic peptide
YISPSGGATFYADSVKG

SEQ ID NO: 4651 - protein, 15 aa, Artificial Sequence
  Description of Artificial Sequence: Synthetic peptide
DRAYGDYVGWNGFDY

SEQ ID NO: 4652 - protein, 11 aa, Artificial Sequence
  Description of Artificial Sequence: Synthetic peptide
RASQSISSFLA

SEQ ID NO: 4653 - protein, 7 aa, Artificial Sequence
  Description of Artificial Sequence: Synthetic peptide
DASYRAT

SEQ ID NO: 4654 - protein, 9 aa, Artificial Sequence
  Description of Artificial Sequence: Synthetic peptide
QQRGNWPIT

SEQ ID NO: 4655 - protein, 5 aa, Artificial Sequence
  Description of Artificial Sequence: Synthetic peptide
TYPMW

SEQ ID NO: 4656 - protein, 17 aa, Artificial Sequence
  Description of Artificial Sequence: Synthetic peptide
YISPSGGGTFYADSVKG

SEQ ID NO: 4657 - protein, 15 aa, Artificial Sequence
  Description of Artificial Sequence: Synthetic peptide
DRAYGDYVGWNGFDY

SEQ ID NO: 4658 - protein, 11 aa, Artificial Sequence
  Description of Artificial Sequence: Synthetic peptide
RASQSISSFLA

SEQ ID NO: 4659 - protein, 7 aa, Artificial Sequence
  Description of Artificial Sequence: Synthetic peptide
DASYRAT

SEQ ID NO: 4660 - protein, 9 aa, Artificial Sequence
  Description of Artificial Sequence: Synthetic peptide
QQRGNWPIT

SEQ ID NO: 4661 - protein, 5 aa, Artificial Sequence
  Description of Artificial Sequence: Synthetic peptide
TYPMW

SEQ ID NO: 4662 - protein, 17 aa, Artificial Sequence
  Description of Artificial Sequence: Synthetic peptide
YIVPSGGYTDYADSVKG

SEQ ID NO: 4663 - protein, 15 aa, Artificial Sequence
  Description of Artificial Sequence: Synthetic peptide
DRAYGDYVGWNGFDY

SEQ ID NO: 4664 - protein, 11 aa, Artificial Sequence
  Description of Artificial Sequence: Synthetic peptide
RASQSISSFLA

SEQ ID NO: 4665 - protein, 7 aa, Artificial Sequence
  Description of Artificial Sequence: Synthetic peptide
DASYRAT

SEQ ID NO: 4666 - protein, 9 aa, Artificial Sequence
  Description of Artificial Sequence: Synthetic peptide
QQRGNWPIT

SEQ ID NO: 4667 - protein, 5 aa, Artificial Sequence
  Description of Artificial Sequence: Synthetic peptide
TYPMW

SEQ ID NO: 4668 - protein, 17 aa, Artificial Sequence
  Description of Artificial Sequence: Synthetic peptide
YIYPSGGGTFYADSVKG

SEQ ID NO: 4669 - protein, 15 aa, Artificial Sequence
  Description of Artificial Sequence: Synthetic peptide
DRAYGDYVGWNGFDY

SEQ ID NO: 4670 - protein, 11 aa, Artificial Sequence
  Description of Artificial Sequence: Synthetic peptide
RASQSISSFLA

SEQ ID NO: 4671 - protein, 7 aa, Artificial Sequence
  Description of Artificial Sequence: Synthetic peptide
DASYRAT

SEQ ID NO: 4672 - protein, 9 aa, Artificial Sequence
  Description of Artificial Sequence: Synthetic peptide
QQRGNWPIT

SEQ ID NO: 4673 - protein, 5 aa, Artificial Sequence
  Description of Artificial Sequence: Synthetic peptide
TYQMW

SEQ ID NO: 4674 - protein, 16 aa, Artificial Sequence
  Description of Artificial Sequence: Synthetic peptide
SIYSSGGTFYADSVKG

SEQ ID NO: 4675 - protein, 15 aa, Artificial Sequence
  Description of Artificial Sequence: Synthetic peptide
DRAYGDYVGWNGFDY

SEQ ID NO: 4676 - protein, 11 aa, Artificial Sequence
  Description of Artificial Sequence: Synthetic peptide
RASQSISSFLA

SEQ ID NO: 4677 - protein, 7 aa, Artificial Sequence
  Description of Artificial Sequence: Synthetic peptide
DASYRAT

SEQ ID NO: 4678 - protein, 9 aa, Artificial Sequence
  Description of Artificial Sequence: Synthetic peptide
QQRGNWPIT

SEQ ID NO: 4679 - protein, 5 aa, Artificial Sequence
  Description of Artificial Sequence: Synthetic peptide
TYSMI

SEQ ID NO: 4680 - protein, 17 aa, Artificial Sequence
  Description of Artificial Sequence: Synthetic peptide
YISPSGGFTDYADSVKG

SEQ ID NO: 4681 - protein, 15 aa, Artificial Sequence
  Description of Artificial Sequence: Synthetic peptide
DRAYGDYVGWNGFDY

SEQ ID NO: 4682 - protein, 11 aa, Artificial Sequence
  Description of Artificial Sequence: Synthetic peptide
RASQSISSFLA

SEQ ID NO: 4683 - protein, 7 aa, Artificial Sequence
  Description of Artificial Sequence: Synthetic peptide
DASYRAT

SEQ ID NO: 4684 - protein, 9 aa, Artificial Sequence
  Description of Artificial Sequence: Synthetic peptide
QQRGNWPIT

SEQ ID NO: 4685 - protein, 5 aa, Artificial Sequence
  Description of Artificial Sequence: Synthetic peptide
VYDMI

SEQ ID NO: 4686 - protein, 17 aa, Artificial Sequence
  Description of Artificial Sequence: Synthetic peptide
YIGPSGGMTLYADSVKG

SEQ ID NO: 4687 - protein, 15 aa, Artificial Sequence
  Description of Artificial Sequence: Synthetic peptide
DRAYGDYVGWNGFDY

SEQ ID NO: 4688 - protein, 11 aa, Artificial Sequence
  Description of Artificial Sequence: Synthetic peptide
RASQSISSFLA

SEQ ID NO: 4689 - protein, 7 aa, Artificial Sequence
  Description of Artificial Sequence: Synthetic peptide
DASYRAT

SEQ ID NO: 4690 - protein, 9 aa, Artificial Sequence
  Description of Artificial Sequence: Synthetic peptide
QQRGNWPIT

SEQ ID NO: 4691 - protein, 5 aa, Artificial Sequence
  Description of Artificial Sequence: Synthetic peptide
VYDMW

SEQ ID NO: 4692 - protein, 17 aa, Artificial Sequence
  Description of Artificial Sequence: Synthetic peptide
VIYPSGGATYYADSVKG

SEQ ID NO: 4693 - protein, 15 aa, Artificial Sequence
  Description of Artificial Sequence: Synthetic peptide
DRAYGDYVGWNGFDY

SEQ ID NO: 4694 - protein, 11 aa, Artificial Sequence
  Description of Artificial Sequence: Synthetic peptide
RASQSISSFLA

SEQ ID NO: 4695 - protein, 7 aa, Artificial Sequence
  Description of Artificial Sequence: Synthetic peptide
DASYRAT

SEQ ID NO: 4696 - protein, 9 aa, Artificial Sequence
  Description of Artificial Sequence: Synthetic peptide
QQRGNWPIT

SEQ ID NO: 4697 - protein, 5 aa, Artificial Sequence
  Description of Artificial Sequence: Synthetic peptide
VYDMW

SEQ ID NO: 4698 - protein, 17 aa, Artificial Sequence
  Description of Artificial Sequence: Synthetic peptide
VIYPSGGYTDYADSVKG

SEQ ID NO: 4699 - protein, 15 aa, Artificial Sequence
  Description of Artificial Sequence: Synthetic peptide
DRAYGDYVGWNGFDY

SEQ ID NO: 4700 - protein, 11 aa, Artificial Sequence
  Description of Artificial Sequence: Synthetic peptide
RASQSISSFLA

SEQ ID NO: 4701 - protein, 7 aa, Artificial Sequence
  Description of Artificial Sequence: Synthetic peptide
DASYRAT

SEQ ID NO: 4702 - protein, 9 aa, Artificial Sequence
  Description of Artificial Sequence: Synthetic peptide
QQRGNWPIT

SEQ ID NO: 4703 - protein, 5 aa, Artificial Sequence
  Description of Artificial Sequence: Synthetic peptide
VYDMW

SEQ ID NO: 4704 - protein, 17 aa, Artificial Sequence
  Description of Artificial Sequence: Synthetic peptide
VIYSSGGATFYADSVKG

SEQ ID NO: 4705 - protein, 15 aa, Artificial Sequence
  Description of Artificial Sequence: Synthetic peptide
DRAYGDYVGWNGFDY

SEQ ID NO: 4706 - protein, 11 aa, Artificial Sequence
  Description of Artificial Sequence: Synthetic peptide
RASQSISSFLA

SEQ ID NO: 4707 - protein, 7 aa, Artificial Sequence
  Description of Artificial Sequence: Synthetic peptide
DASYRAT

SEQ ID NO: 4708 - protein, 9 aa, Artificial Sequence
  Description of Artificial Sequence: Synthetic peptide
QQRGNWPIT

SEQ ID NO: 4709 - protein, 5 aa, Artificial Sequence
  Description of Artificial Sequence: Synthetic peptide
VYDMW

SEQ ID NO: 4710 - protein, 17 aa, Artificial Sequence
  Description of Artificial Sequence: Synthetic peptide
VIYSSGGPTFYADSVKG

SEQ ID NO: 4711 - protein, 15 aa, Artificial Sequence
  Description of Artificial Sequence: Synthetic peptide
DRAYGDYVGWNGFDY

SEQ ID NO: 4712 - protein, 11 aa, Artificial Sequence
  Description of Artificial Sequence: Synthetic peptide
RASQSISSFLA

SEQ ID NO: 4713 - protein, 7 aa, Artificial Sequence
  Description of Artificial Sequence: Synthetic peptide
DASYRAT

SEQ ID NO: 4714 - protein, 9 aa, Artificial Sequence
  Description of Artificial Sequence: Synthetic peptide
QQRGNWPIT

SEQ ID NO: 4715 - protein, 5 aa, Artificial Sequence
  Description of Artificial Sequence: Synthetic peptide
VYDMW

SEQ ID NO: 4716 - protein, 17 aa, Artificial Sequence
  Description of Artificial Sequence: Synthetic peptide
YISPSGGFTDYADSVKG

SEQ ID NO: 4717 - protein, 15 aa, Artificial Sequence
  Description of Artificial Sequence: Synthetic peptide
DRAYGDYVGWNGFDY

SEQ ID NO: 4718 - protein, 11 aa, Artificial Sequence
  Description of Artificial Sequence: Synthetic peptide
RASQSISSFLA

SEQ ID NO: 4719 - protein, 7 aa, Artificial Sequence
  Description of Artificial Sequence: Synthetic peptide
DASYRAT

SEQ ID NO: 4720 - protein, 9 aa, Artificial Sequence
  Description of Artificial Sequence: Synthetic peptide
QQRGNWPIT

SEQ ID NO: 4721 - protein, 5 aa, Artificial Sequence
  Description of Artificial Sequence: Synthetic peptide
VYEMW

SEQ ID NO: 4722 - protein, 17 aa, Artificial Sequence
  Description of Artificial Sequence: Synthetic peptide
YISPSGGGTFYADSVKG

SEQ ID NO: 4723 - protein, 15 aa, Artificial Sequence
  Description of Artificial Sequence: Synthetic peptide
DRAYGDYVGWNGFDY

SEQ ID NO: 4724 - protein, 11 aa, Artificial Sequence
  Description of Artificial Sequence: Synthetic peptide
RASQSISSFLA

SEQ ID NO: 4725 - protein, 7 aa, Artificial Sequence
  Description of Artificial Sequence: Synthetic peptide
DASYRAT

SEQ ID NO: 4726 - protein, 9 aa, Artificial Sequence
  Description of Artificial Sequence: Synthetic peptide
QQRGNWPIT

SEQ ID NO: 4727 - protein, 5 aa, Artificial Sequence
  Description of Artificial Sequence: Synthetic peptide
VYNMW

SEQ ID NO: 4728 - protein, 17 aa, Artificial Sequence
  Description of Artificial Sequence: Synthetic peptide
SISPSGGGTFYADSVKG

SEQ ID NO: 4729 - protein, 15 aa, Artificial Sequence
  Description of Artificial Sequence: Synthetic peptide
DRAYGDYVGWNGFDY

SEQ ID NO: 4730 - protein, 11 aa, Artificial Sequence
  Description of Artificial Sequence: Synthetic peptide
RASQSISSFLA

SEQ ID NO: 4731 - protein, 7 aa, Artificial Sequence
  Description of Artificial Sequence: Synthetic peptide
DASYRAT

SEQ ID NO: 4732 - protein, 9 aa, Artificial Sequence
  Description of Artificial Sequence: Synthetic peptide
QQRGNWPIT

SEQ ID NO: 4733 - protein, 5 aa, Artificial Sequence
  Description of Artificial Sequence: Synthetic peptide
VYPMW

SEQ ID NO: 4734 - protein, 17 aa, Artificial Sequence
  Description of Artificial Sequence: Synthetic peptide
SISPSGGATYYADSVKG

SEQ ID NO: 4735 - protein, 15 aa, Artificial Sequence
  Description of Artificial Sequence: Synthetic peptide
DRAYGDYVGWNGFDY

SEQ ID NO: 4736 - protein, 11 aa, Artificial Sequence
  Description of Artificial Sequence: Synthetic peptide
RASQSISSFLA

SEQ ID NO: 4737 - protein, 7 aa, Artificial Sequence
  Description of Artificial Sequence: Synthetic peptide
DASYRAT

SEQ ID NO: 4738 - protein, 9 aa, Artificial Sequence
  Description of Artificial Sequence: Synthetic peptide
QQRGNWPIT

SEQ ID NO: 4739 - protein, 5 aa, Artificial Sequence
  Description of Artificial Sequence: Synthetic peptide
VYPMW

SEQ ID NO: 4740 - protein, 17 aa, Artificial Sequence
  Description of Artificial Sequence: Synthetic peptide
SISPSGGYTGYADSVKG

SEQ ID NO: 4741 - protein, 15 aa, Artificial Sequence
  Description of Artificial Sequence: Synthetic peptide
DRAYGDYVGWNGFDY

SEQ ID NO: 4742 - protein, 11 aa, Artificial Sequence
  Description of Artificial Sequence: Synthetic peptide
RASQSISSFLA

SEQ ID NO: 4743 - protein, 7 aa, Artificial Sequence
  Description of Artificial Sequence: Synthetic peptide
DASYRAT

SEQ ID NO: 4744 - protein, 9 aa, Artificial Sequence
  Description of Artificial Sequence: Synthetic peptide
QQRGNWPIT

SEQ ID NO: 4745 - protein, 5 aa, Artificial Sequence
  Description of Artificial Sequence: Synthetic peptide
VYPMW

SEQ ID NO: 4746 - protein, 16 aa, Artificial Sequence
  Description of Artificial Sequence: Synthetic peptide
SISSGGATYYADSVKG

SEQ ID NO: 4747 - protein, 15 aa, Artificial Sequence
  Description of Artificial Sequence: Synthetic peptide
DRAYGDYVGWNGFDY

SEQ ID NO: 4748 - protein, 11 aa, Artificial Sequence
  Description of Artificial Sequence: Synthetic peptide
RASQSISSFLA

SEQ ID NO: 4749 - protein, 7 aa, Artificial Sequence
  Description of Artificial Sequence: Synthetic peptide
DASYRAT

SEQ ID NO: 4750 - protein, 9 aa, Artificial Sequence
  Description of Artificial Sequence: Synthetic peptide
QQRGNWPIT

SEQ ID NO: 4751 - protein, 5 aa, Artificial Sequence
  Description of Artificial Sequence: Synthetic peptide
VYPMW

SEQ ID NO: 4752 - protein, 17 aa, Artificial Sequence
  Description of Artificial Sequence: Synthetic peptide
WISPSGGGTFYADSVKG

SEQ ID NO: 4753 - protein, 15 aa, Artificial Sequence
  Description of Artificial Sequence: Synthetic peptide
DRAYGDYVGWNGFDY

SEQ ID NO: 4754 - protein, 11 aa, Artificial Sequence
  Description of Artificial Sequence: Synthetic peptide
RASQSISSFLA

SEQ ID NO: 4755 - protein, 7 aa, Artificial Sequence
  Description of Artificial Sequence: Synthetic peptide
DASYRAT

SEQ ID NO: 4756 - protein, 9 aa, Artificial Sequence
  Description of Artificial Sequence: Synthetic peptide
QQRGNWPIT

SEQ ID NO: 4757 - protein, 5 aa, Artificial Sequence
  Description of Artificial Sequence: Synthetic peptide
VYPMW

SEQ ID NO: 4758 - protein, 17 aa, Artificial Sequence
  Description of Artificial Sequence: Synthetic peptide
WISSSGGGTAYADSVKG

SEQ ID NO: 4759 - protein, 15 aa, Artificial Sequence
  Description of Artificial Sequence: Synthetic peptide
DRAYGDYVGWNGFDY

SEQ ID NO: 4760 - protein, 11 aa, Artificial Sequence
  Description of Artificial Sequence: Synthetic peptide
RASQSISSFLA

SEQ ID NO: 4761 - protein, 7 aa, Artificial Sequence
  Description of Artificial Sequence: Synthetic peptide
DASYRAT

SEQ ID NO: 4762 - protein, 9 aa, Artificial Sequence
  Description of Artificial Sequence: Synthetic peptide
QQRGNWPIT

SEQ ID NO: 4763 - protein, 5 aa, Artificial Sequence
  Description of Artificial Sequence: Synthetic peptide
VYPMW

SEQ ID NO: 4764 - protein, 17 aa, Artificial Sequence
  Description of Artificial Sequence: Synthetic peptide
YIVPSGGATYYADSVKG

SEQ ID NO: 4765 - protein, 15 aa, Artificial Sequence
  Description of Artificial Sequence: Synthetic peptide
DRAYGDYVGWNGFDY

SEQ ID NO: 4766 - protein, 11 aa, Artificial Sequence
  Description of Artificial Sequence: Synthetic peptide
RASQSISSFLA

SEQ ID NO: 4767 - protein, 7 aa, Artificial Sequence
  Description of Artificial Sequence: Synthetic peptide
DASYRAT

SEQ ID NO: 4768 - protein, 9 aa, Artificial Sequence
  Description of Artificial Sequence: Synthetic peptide
QQRGNWPIT

SEQ ID NO: 4769 - protein, 5 aa, Artificial Sequence
  Description of Artificial Sequence: Synthetic peptide
VYPMW

SEQ ID NO: 4770 - protein, 17 aa, Artificial Sequence
  Description of Artificial Sequence: Synthetic peptide
YIYPSGGATYYADSVKG

SEQ ID NO: 4771 - protein, 15 aa, Artificial Sequence
  Description of Artificial Sequence: Synthetic peptide
DRAYGDYVGWNGFDY

SEQ ID NO: 4772 - protein, 11 aa, Artificial Sequence
  Description of Artificial Sequence: Synthetic peptide
RASQSISSFLA

SEQ ID NO: 4773 - protein, 7 aa, Artificial Sequence
  Description of Artificial Sequence: Synthetic peptide
DASYRAT

SEQ ID NO: 4774 - protein, 9 aa, Artificial Sequence
  Description of Artificial Sequence: Synthetic peptide
QQRGNWPIT

SEQ ID NO: 4775 - protein, 5 aa, Artificial Sequence
  Description of Artificial Sequence: Synthetic peptide
VYQMW

SEQ ID NO: 4776 - protein, 17 aa, Artificial Sequence
  Description of Artificial Sequence: Synthetic peptide
VIYPSGGTTFYADSVKG

SEQ ID NO: 4777 - protein, 15 aa, Artificial Sequence
  Description of Artificial Sequence: Synthetic peptide
DRAYGDYVGWNGFDY

SEQ ID NO: 4778 - protein, 11 aa, Artificial Sequence
  Description of Artificial Sequence: Synthetic peptide
RASQSISSFLA

SEQ ID NO: 4779 - protein, 7 aa, Artificial Sequence
  Description of Artificial Sequence: Synthetic peptide
DASYRAT

SEQ ID NO: 4780 - protein, 9 aa, Artificial Sequence
  Description of Artificial Sequence: Synthetic peptide
QQRGNWPIT

SEQ ID NO: 4781 - protein, 5 aa, Artificial Sequence
  Description of Artificial Sequence: Synthetic peptide
VYWMI

SEQ ID NO: 4782 - protein, 17 aa, Artificial Sequence
  Description of Artificial Sequence: Synthetic peptide
YISPSGGGTFYADSVKG

SEQ ID NO: 4783 - protein, 15 aa, Artificial Sequence
  Description of Artificial Sequence: Synthetic peptide
DRAYGDYVGWNGFDY

SEQ ID NO: 4784 - protein, 11 aa, Artificial Sequence
  Description of Artificial Sequence: Synthetic peptide
RASQSISSFLA

SEQ ID NO: 4785 - protein, 7 aa, Artificial Sequence
  Description of Artificial Sequence: Synthetic peptide
DASYRAT

SEQ ID NO: 4786 - protein, 9 aa, Artificial Sequence
  Description of Artificial Sequence: Synthetic peptide
QQRGNWPIT

SEQ ID NO: 4787 - protein, 5 aa, Artificial Sequence
  Description of Artificial Sequence: Synthetic peptide
WYAMW

SEQ ID NO: 4788 - protein, 17 aa, Artificial Sequence
  Description of Artificial Sequence: Synthetic peptide
SISPSGGGTYYADSVKG

SEQ ID NO: 4789 - protein, 15 aa, Artificial Sequence
  Description of Artificial Sequence: Synthetic peptide
DRAYGDYVGWNGFDY

SEQ ID NO: 4790 - protein, 11 aa, Artificial Sequence
  Description of Artificial Sequence: Synthetic peptide
RASQSISSFLA

SEQ ID NO: 4791 - protein, 7 aa, Artificial Sequence
  Description of Artificial Sequence: Synthetic peptide
DASYRAT

SEQ ID NO: 4792 - protein, 9 aa, Artificial Sequence
  Description of Artificial Sequence: Synthetic peptide
QQRGNWPIT

SEQ ID NO: 4793 - protein, 5 aa, Artificial Sequence
  Description of Artificial Sequence: Synthetic peptide
WYDMF

SEQ ID NO: 4794 - protein, 17 aa, Artificial Sequence
  Description of Artificial Sequence: Synthetic peptide
SISPSGGATFYADSVKG

SEQ ID NO: 4795 - protein, 15 aa, Artificial Sequence
  Description of Artificial Sequence: Synthetic peptide
DRAYGDYVGWNGFDY

SEQ ID NO: 4796 - protein, 11 aa, Artificial Sequence
  Description of Artificial Sequence: Synthetic peptide
RASQSISSFLA

SEQ ID NO: 4797 - protein, 7 aa, Artificial Sequence
  Description of Artificial Sequence: Synthetic peptide
DASYRAT

SEQ ID NO: 4798 - protein, 9 aa, Artificial Sequence
  Description of Artificial Sequence: Synthetic peptide
QQRGNWPIT

SEQ ID NO: 4799 - protein, 5 aa, Artificial Sequence
  Description of Artificial Sequence: Synthetic peptide
WYDMW

SEQ ID NO: 4800 - protein, 17 aa, Artificial Sequence
  Description of Artificial Sequence: Synthetic peptide
VIYPSGGATYYADSVKG

SEQ ID NO: 4801 - protein, 15 aa, Artificial Sequence
  Description of Artificial Sequence: Synthetic peptide
DRAYGDYVGWNGFDY

SEQ ID NO: 4802 - protein, 11 aa, Artificial Sequence
  Description of Artificial Sequence: Synthetic peptide
RASQSISSFLA

SEQ ID NO: 4803 - protein, 7 aa, Artificial Sequence
  Description of Artificial Sequence: Synthetic peptide
DASYRAT

SEQ ID NO: 4804 - protein, 9 aa, Artificial Sequence
  Description of Artificial Sequence: Synthetic peptide
QQRGNWPIT

SEQ ID NO: 4805 - protein, 5 aa, Artificial Sequence
  Description of Artificial Sequence: Synthetic peptide
WYDMW

SEQ ID NO: 4806 - protein, 17 aa, Artificial Sequence
  Description of Artificial Sequence: Synthetic peptide
VIYPSGGFTDYADSVKG

SEQ ID NO: 4807 - protein, 15 aa, Artificial Sequence
  Description of Artificial Sequence: Synthetic peptide
DRAYGDYVGWNGFDY

SEQ ID NO: 4808 - protein, 11 aa, Artificial Sequence
  Description of Artificial Sequence: Synthetic peptide
RASQSISSFLA

SEQ ID NO: 4809 - protein, 7 aa, Artificial Sequence
  Description of Artificial Sequence: Synthetic peptide
DASYRAT

SEQ ID NO: 4810 - protein, 9 aa, Artificial Sequence
  Description of Artificial Sequence: Synthetic peptide
QQRGNWPIT

SEQ ID NO: 4811 - protein, 5 aa, Artificial Sequence
  Description of Artificial Sequence: Synthetic peptide
WYDMW

SEQ ID NO: 4812 - protein, 17 aa, Artificial Sequence
  Description of Artificial Sequence: Synthetic peptide
VIYPSGGYTGYADSVKG

SEQ ID NO: 4813 - protein, 15 aa, Artificial Sequence
  Description of Artificial Sequence: Synthetic peptide
DRAYGDYVGWNGFDY

SEQ ID NO: 4814 - protein, 11 aa, Artificial Sequence
  Description of Artificial Sequence: Synthetic peptide
RASQSISSFLA

SEQ ID NO: 4815 - protein, 7 aa, Artificial Sequence
  Description of Artificial Sequence: Synthetic peptide
DASYRAT

SEQ ID NO: 4816 - protein, 9 aa, Artificial Sequence
  Description of Artificial Sequence: Synthetic peptide
QQRGNWPIT

SEQ ID NO: 4817 - protein, 5 aa, Artificial Sequence
  Description of Artificial Sequence: Synthetic peptide
WYDMW

SEQ ID NO: 4818 - protein, 17 aa, Artificial Sequence
  Description of Artificial Sequence: Synthetic peptide
VIYSSGGATFYADSVKG

SEQ ID NO: 4819 - protein, 15 aa, Artificial Sequence
  Description of Artificial Sequence: Synthetic peptide
DRAYGDYVGWNGFDY

SEQ ID NO: 4820 - protein, 11 aa, Artificial Sequence
  Description of Artificial Sequence: Synthetic peptide
RASQSISSFLA

SEQ ID NO: 4821 - protein, 7 aa, Artificial Sequence
  Description of Artificial Sequence: Synthetic peptide
DASYRAT

SEQ ID NO: 4822 - protein, 9 aa, Artificial Sequence
  Description of Artificial Sequence: Synthetic peptide
QQRGNWPIT

SEQ ID NO: 4823 - protein, 5 aa, Artificial Sequence
  Description of Artificial Sequence: Synthetic peptide
WYDMW

SEQ ID NO: 4824 - protein, 17 aa, Artificial Sequence
  Description of Artificial Sequence: Synthetic peptide
VIYSSGGPTFYADSVKG

SEQ ID NO: 4825 - protein, 15 aa, Artificial Sequence
  Description of Artificial Sequence: Synthetic peptide
DRAYGDYVGWNGFDY

SEQ ID NO: 4826 - protein, 11 aa, Artificial Sequence
  Description of Artificial Sequence: Synthetic peptide
RASQSISSFLA

SEQ ID NO: 4827 - protein, 7 aa, Artificial Sequence
  Description of Artificial Sequence: Synthetic peptide
DASYRAT

SEQ ID NO: 4828 - protein, 9 aa, Artificial Sequence
  Description of Artificial Sequence: Synthetic peptide
QQRGNWPIT

SEQ ID NO: 4829 - protein, 5 aa, Artificial Sequence
  Description of Artificial Sequence: Synthetic peptide
WYEMW

SEQ ID NO: 4830 - protein, 17 aa, Artificial Sequence
  Description of Artificial Sequence: Synthetic peptide
WISPSGGGTQYADSVKG

SEQ ID NO: 4831 - protein, 15 aa, Artificial Sequence
  Description of Artificial Sequence: Synthetic peptide
DRAYGDYVGWNGFDY

SEQ ID NO: 4832 - protein, 11 aa, Artificial Sequence
  Description of Artificial Sequence: Synthetic peptide
RASQSISSFLA

SEQ ID NO: 4833 - protein, 7 aa, Artificial Sequence
  Description of Artificial Sequence: Synthetic peptide
DASYRAT

SEQ ID NO: 4834 - protein, 9 aa, Artificial Sequence
  Description of Artificial Sequence: Synthetic peptide
QQRGNWPIT

SEQ ID NO: 4835 - protein, 5 aa, Artificial Sequence
  Description of Artificial Sequence: Synthetic peptide
WYEMW

SEQ ID NO: 4836 - protein, 17 aa, Artificial Sequence
  Description of Artificial Sequence: Synthetic peptide
YISPSGGGTYYADSVKG

SEQ ID NO: 4837 - protein, 15 aa, Artificial Sequence
  Description of Artificial Sequence: Synthetic peptide
DRAYGDYVGWNGFDY

SEQ ID NO: 4838 - protein, 11 aa, Artificial Sequence
  Description of Artificial Sequence: Synthetic peptide
RASQSISSFLA

SEQ ID NO: 4839 - protein, 7 aa, Artificial Sequence
  Description of Artificial Sequence: Synthetic peptide
DASYRAT

SEQ ID NO: 4840 - protein, 9 aa, Artificial Sequence
  Description of Artificial Sequence: Synthetic peptide
QQRGNWPIT

SEQ ID NO: 4841 - protein, 5 aa, Artificial Sequence
  Description of Artificial Sequence: Synthetic peptide
WYNMW

SEQ ID NO: 4842 - protein, 17 aa, Artificial Sequence
  Description of Artificial Sequence: Synthetic peptide
VIYPSGGGTFYADSVKG

SEQ ID NO: 4843 - protein, 15 aa, Artificial Sequence
  Description of Artificial Sequence: Synthetic peptide
DRAYGDYVGWNGFDY

SEQ ID NO: 4844 - protein, 11 aa, Artificial Sequence
  Description of Artificial Sequence: Synthetic peptide
RASQSISSFLA

SEQ ID NO: 4845 - protein, 7 aa, Artificial Sequence
  Description of Artificial Sequence: Synthetic peptide
DASYRAT

SEQ ID NO: 4846 - protein, 9 aa, Artificial Sequence
  Description of Artificial Sequence: Synthetic peptide
QQRGNWPIT

SEQ ID NO: 4847 - protein, 5 aa, Artificial Sequence
  Description of Artificial Sequence: Synthetic peptide
WYNMW

SEQ ID NO: 4848 - protein, 17 aa, Artificial Sequence
  Description of Artificial Sequence: Synthetic peptide
YIVSSGGFTDYADSVKG

SEQ ID NO: 4849 - protein, 15 aa, Artificial Sequence
  Description of Artificial Sequence: Synthetic peptide
DRAYGDYVGWNGFDY

SEQ ID NO: 4850 - protein, 11 aa, Artificial Sequence
  Description of Artificial Sequence: Synthetic peptide
RASQSISSFLA

SEQ ID NO: 4851 - protein, 7 aa, Artificial Sequence
  Description of Artificial Sequence: Synthetic peptide
DASYRAT

SEQ ID NO: 4852 - protein, 9 aa, Artificial Sequence
  Description of Artificial Sequence: Synthetic peptide
QQRGNWPIT

SEQ ID NO: 4853 - protein, 5 aa, Artificial Sequence
  Description of Artificial Sequence: Synthetic peptide
WYPMI

SEQ ID NO: 4854 - protein, 17 aa, Artificial Sequence
  Description of Artificial Sequence: Synthetic peptide
YISSSGGYTSYADSVKG

SEQ ID NO: 4855 - protein, 15 aa, Artificial Sequence
  Description of Artificial Sequence: Synthetic peptide
DRAYGDYVGWNGFDY

SEQ ID NO: 4856 - protein, 11 aa, Artificial Sequence
  Description of Artificial Sequence: Synthetic peptide
RASQSISSFLA

SEQ ID NO: 4857 - protein, 7 aa, Artificial Sequence
  Description of Artificial Sequence: Synthetic peptide
DASYRAT

SEQ ID NO: 4858 - protein, 9 aa, Artificial Sequence
  Description of Artificial Sequence: Synthetic peptide
QQRGNWPIT

SEQ ID NO: 4859 - protein, 5 aa, Artificial Sequence
  Description of Artificial Sequence: Synthetic peptide
WYPMT

SEQ ID NO: 4860 - protein, 17 aa, Artificial Sequence
  Description of Artificial Sequence: Synthetic peptide
YISPSGGYTGYADSVKG

SEQ ID NO: 4861 - protein, 15 aa, Artificial Sequence
  Description of Artificial Sequence: Synthetic peptide
DRAYGDYVGWNGFDY

SEQ ID NO: 4862 - protein, 11 aa, Artificial Sequence
  Description of Artificial Sequence: Synthetic peptide
RASQSISSFLA

SEQ ID NO: 4863 - protein, 7 aa, Artificial Sequence
  Description of Artificial Sequence: Synthetic peptide
DASYRAT

SEQ ID NO: 4864 - protein, 9 aa, Artificial Sequence
  Description of Artificial Sequence: Synthetic peptide
QQRGNWPIT

SEQ ID NO: 4865 - protein, 5 aa, Artificial Sequence
  Description of Artificial Sequence: Synthetic peptide
WYPMV

SEQ ID NO: 4866 - protein, 17 aa, Artificial Sequence
  Description of Artificial Sequence: Synthetic peptide
YIYPSGGGTFYADSVKG

SEQ ID NO: 4867 - protein, 15 aa, Artificial Sequence
  Description of Artificial Sequence: Synthetic peptide
DRAYGDYVGWNGFDY

SEQ ID NO: 4868 - protein, 11 aa, Artificial Sequence
  Description of Artificial Sequence: Synthetic peptide
RASQSISSFLA

SEQ ID NO: 4869 - protein, 7 aa, Artificial Sequence
  Description of Artificial Sequence: Synthetic peptide
DASYRAT

SEQ ID NO: 4870 - protein, 9 aa, Artificial Sequence
  Description of Artificial Sequence: Synthetic peptide
QQRGNWPIT

SEQ ID NO: 4871 - protein, 5 aa, Artificial Sequence
  Description of Artificial Sequence: Synthetic peptide
WYPMW

SEQ ID NO: 4872 - protein, 17 aa, Artificial Sequence
  Description of Artificial Sequence: Synthetic peptide
SISPSGGATYYADSVKG

SEQ ID NO: 4873 - protein, 15 aa, Artificial Sequence
  Description of Artificial Sequence: Synthetic peptide
DRAYGDYVGWNGFDY

SEQ ID NO: 4874 - protein, 11 aa, Artificial Sequence
  Description of Artificial Sequence: Synthetic peptide
RASQSISSFLA

SEQ ID NO: 4875 - protein, 7 aa, Artificial Sequence
  Description of Artificial Sequence: Synthetic peptide
DASYRAT

SEQ ID NO: 4876 - protein, 9 aa, Artificial Sequence
  Description of Artificial Sequence: Synthetic peptide
QQRGNWPIT

SEQ ID NO: 4877 - protein, 5 aa, Artificial Sequence
  Description of Artificial Sequence: Synthetic peptide
WYPMW

SEQ ID NO: 4878 - protein, 17 aa, Artificial Sequence
  Description of Artificial Sequence: Synthetic peptide
SIVPSGGATYYADSVKG

SEQ ID NO: 4879 - protein, 15 aa, Artificial Sequence
  Description of Artificial Sequence: Synthetic peptide
DRAYGDYVGWNGFDY

SEQ ID NO: 4880 - protein, 11 aa, Artificial Sequence
  Description of Artificial Sequence: Synthetic peptide
RASQSISSFLA

SEQ ID NO: 4881 - protein, 7 aa, Artificial Sequence
  Description of Artificial Sequence: Synthetic peptide
DASYRAT

SEQ ID NO: 4882 - protein, 9 aa, Artificial Sequence
  Description of Artificial Sequence: Synthetic peptide
QQRGNWPIT

SEQ ID NO: 4883 - protein, 5 aa, Artificial Sequence
  Description of Artificial Sequence: Synthetic peptide
WYPMW

SEQ ID NO: 4884 - protein, 17 aa, Artificial Sequence
  Description of Artificial Sequence: Synthetic peptide
VIYPSGGYTSYADSVKG

SEQ ID NO: 4885 - protein, 15 aa, Artificial Sequence
  Description of Artificial Sequence: Synthetic peptide
DRAYGDYVGWNGFDY

SEQ ID NO: 4886 - protein, 11 aa, Artificial Sequence
  Description of Artificial Sequence: Synthetic peptide
RASQSISSFLA

SEQ ID NO: 4887 - protein, 7 aa, Artificial Sequence
  Description of Artificial Sequence: Synthetic peptide
DASYRAT

SEQ ID NO: 4888 - protein, 9 aa, Artificial Sequence
  Description of Artificial Sequence: Synthetic peptide
QQRGNWPIT

SEQ ID NO: 4889 - protein, 5 aa, Artificial Sequence
  Description of Artificial Sequence: Synthetic peptide
WYPMW

SEQ ID NO: 4890 - protein, 17 aa, Artificial Sequence
  Description of Artificial Sequence: Synthetic peptide
VIYSSGGATFYADSVKG

SEQ ID NO: 4891 - protein, 15 aa, Artificial Sequence
  Description of Artificial Sequence: Synthetic peptide
DRAYGDYVGWNGFDY

SEQ ID NO: 4892 - protein, 11 aa, Artificial Sequence
  Description of Artificial Sequence: Synthetic peptide
RASQSISSFLA

SEQ ID NO: 4893 - protein, 7 aa, Artificial Sequence
  Description of Artificial Sequence: Synthetic peptide
DASYRAT

SEQ ID NO: 4894 - protein, 9 aa, Artificial Sequence
  Description of Artificial Sequence: Synthetic peptide
QQRGNWPIT

SEQ ID NO: 4895 - protein, 5 aa, Artificial Sequence
  Description of Artificial Sequence: Synthetic peptide
WYPMW

SEQ ID NO: 4896 - protein, 17 aa, Artificial Sequence
  Description of Artificial Sequence: Synthetic peptide
VIYSSGGYTGYADSVKG

SEQ ID NO: 4897 - protein, 15 aa, Artificial Sequence
  Description of Artificial Sequence: Synthetic peptide
DRAYGDYVGWNGFDY

SEQ ID NO: 4898 - protein, 11 aa, Artificial Sequence
  Description of Artificial Sequence: Synthetic peptide
RASQSISSFLA

SEQ ID NO: 4899 - protein, 7 aa, Artificial Sequence
  Description of Artificial Sequence: Synthetic peptide
DASYRAT

SEQ ID NO: 4900 - protein, 9 aa, Artificial Sequence
  Description of Artificial Sequence: Synthetic peptide
QQRGNWPIT

SEQ ID NO: 4901 - protein, 5 aa, Artificial Sequence
  Description of Artificial Sequence: Synthetic peptide
WYPMW

SEQ ID NO: 4902 - protein, 17 aa, Artificial Sequence
  Description of Artificial Sequence: Synthetic peptide
YIVPSGGATFYADSVKG

SEQ ID NO: 4903 - protein, 15 aa, Artificial Sequence
  Description of Artificial Sequence: Synthetic peptide
DRAYGDYVGWNGFDY

SEQ ID NO: 4904 - protein, 11 aa, Artificial Sequence
  Description of Artificial Sequence: Synthetic peptide
RASQSISSFLA

SEQ ID NO: 4905 - protein, 7 aa, Artificial Sequence
  Description of Artificial Sequence: Synthetic peptide
DASYRAT

SEQ ID NO: 4906 - protein, 9 aa, Artificial Sequence
  Description of Artificial Sequence: Synthetic peptide
QQRGNWPIT

SEQ ID NO: 4907 - protein, 5 aa, Artificial Sequence
  Description of Artificial Sequence: Synthetic peptide
WYPMW

SEQ ID NO: 4908 - protein, 17 aa, Artificial Sequence
  Description of Artificial Sequence: Synthetic peptide
YIVPSGGRTYYADSVKG

SEQ ID NO: 4909 - protein, 15 aa, Artificial Sequence
  Description of Artificial Sequence: Synthetic peptide
DRAYGDYVGWNGFDY

SEQ ID NO: 4910 - protein, 11 aa, Artificial Sequence
  Description of Artificial Sequence: Synthetic peptide
RASQSISSFLA

SEQ ID NO: 4911 - protein, 7 aa, Artificial Sequence
  Description of Artificial Sequence: Synthetic peptide
DASYRAT

SEQ ID NO: 4912 - protein, 9 aa, Artificial Sequence
  Description of Artificial Sequence: Synthetic peptide
QQRGNWPIT

SEQ ID NO: 4913 - protein, 5 aa, Artificial Sequence
  Description of Artificial Sequence: Synthetic peptide
WYSMW

SEQ ID NO: 4914 - protein, 17 aa, Artificial Sequence
  Description of Artificial Sequence: Synthetic peptide
VIYPSGGGTFYADSVKG

SEQ ID NO: 4915 - protein, 15 aa, Artificial Sequence
  Description of Artificial Sequence: Synthetic peptide
DRAYGDYVGWNGFDY

SEQ ID NO: 4916 - protein, 11 aa, Artificial Sequence
  Description of Artificial Sequence: Synthetic peptide
RASQSISSFLA

SEQ ID NO: 4917 - protein, 7 aa, Artificial Sequence
  Description of Artificial Sequence: Synthetic peptide
DASYRAT

SEQ ID NO: 4918 - protein, 9 aa, Artificial Sequence
  Description of Artificial Sequence: Synthetic peptide
QQRGNWPIT

SEQ ID NO: 4919 - protein, 5 aa, Artificial Sequence
  Description of Artificial Sequence: Synthetic peptide
WYTMW

SEQ ID NO: 4920 - protein, 17 aa, Artificial Sequence
  Description of Artificial Sequence: Synthetic peptide
SISPSGGGTYYADSVKG

SEQ ID NO: 4921 - protein, 15 aa, Artificial Sequence
  Description of Artificial Sequence: Synthetic peptide
DRAYGDYVGWNGFDY

SEQ ID NO: 4922 - protein, 11 aa, Artificial Sequence
  Description of Artificial Sequence: Synthetic peptide
RASQSISSFLA

SEQ ID NO: 4923 - protein, 7 aa, Artificial Sequence
  Description of Artificial Sequence: Synthetic peptide
DASYRAT

SEQ ID NO: 4924 - protein, 9 aa, Artificial Sequence
  Description of Artificial Sequence: Synthetic peptide
QQRGNWPIT

SEQ ID NO: 4925 - protein, 5 aa, Artificial Sequence
  Description of Artificial Sequence: Synthetic peptide
WYYMI

SEQ ID NO: 4926 - protein, 17 aa, Artificial Sequence
  Description of Artificial Sequence: Synthetic peptide
YISPSGGGTYYADSVKG

SEQ ID NO: 4927 - protein, 15 aa, Artificial Sequence
  Description of Artificial Sequence: Synthetic peptide
DRAYGDYVGWNGFDY

SEQ ID NO: 4928 - protein, 11 aa, Artificial Sequence
  Description of Artificial Sequence: Synthetic peptide
RASQSISSFLA

SEQ ID NO: 4929 - protein, 7 aa, Artificial Sequence
  Description of Artificial Sequence: Synthetic peptide
DASYRAT

SEQ ID NO: 4930 - protein, 9 aa, Artificial Sequence
  Description of Artificial Sequence: Synthetic peptide
QQRGNWPIT

SEQ ID NO: 4931 - protein, 5 aa, Artificial Sequence
  Description of Artificial Sequence: Synthetic peptide
YYDMI

SEQ ID NO: 4932 - protein, 17 aa, Artificial Sequence
  Description of Artificial Sequence: Synthetic peptide
WISPSGGLTMYADSVKG

SEQ ID NO: 4933 - protein, 15 aa, Artificial Sequence
  Description of Artificial Sequence: Synthetic peptide
DRAYGDYVGWNGFDY

SEQ ID NO: 4934 - protein, 11 aa, Artificial Sequence
  Description of Artificial Sequence: Synthetic peptide
RASQSISSFLA

SEQ ID NO: 4935 - protein, 7 aa, Artificial Sequence
  Description of Artificial Sequence: Synthetic peptide
DASYRAT

SEQ ID NO: 4936 - protein, 9 aa, Artificial Sequence
  Description of Artificial Sequence: Synthetic peptide
QQRGNWPIT

SEQ ID NO: 4937 - protein, 5 aa, Artificial Sequence
  Description of Artificial Sequence: Synthetic peptide
YYDMI

SEQ ID NO: 4938 - protein, 17 aa, Artificial Sequence
  Description of Artificial Sequence: Synthetic peptide
YIVPSGGYTSYADSVKG

SEQ ID NO: 4939 - protein, 15 aa, Artificial Sequence
  Description of Artificial Sequence: Synthetic peptide
DRAYGDYVGWNGFDY

SEQ ID NO: 4940 - protein, 11 aa, Artificial Sequence
  Description of Artificial Sequence: Synthetic peptide
RASQSISSFLA

SEQ ID NO: 4941 - protein, 7 aa, Artificial Sequence
  Description of Artificial Sequence: Synthetic peptide
DASYRAT

SEQ ID NO: 4942 - protein, 9 aa, Artificial Sequence
  Description of Artificial Sequence: Synthetic peptide
QQRGNWPIT

SEQ ID NO: 4943 - protein, 5 aa, Artificial Sequence
  Description of Artificial Sequence: Synthetic peptide
YYDMV

SEQ ID NO: 4944 - protein, 17 aa, Artificial Sequence
  Description of Artificial Sequence: Synthetic peptide
YISPSGGFTLYADSVKG

SEQ ID NO: 4945 - protein, 15 aa, Artificial Sequence
  Description of Artificial Sequence: Synthetic peptide
DRAYGDYVGWNGFDY

SEQ ID NO: 4946 - protein, 11 aa, Artificial Sequence
  Description of Artificial Sequence: Synthetic peptide
RASQSISSFLA

SEQ ID NO: 4947 - protein, 7 aa, Artificial Sequence
  Description of Artificial Sequence: Synthetic peptide
DASYRAT

SEQ ID NO: 4948 - protein, 9 aa, Artificial Sequence
  Description of Artificial Sequence: Synthetic peptide
QQRGNWPIT

SEQ ID NO: 4949 - protein, 5 aa, Artificial Sequence
  Description of Artificial Sequence: Synthetic peptide
YYDMW

SEQ ID NO: 4950 - protein, 17 aa, Artificial Sequence
  Description of Artificial Sequence: Synthetic peptide
SISPSGGFTGYADSVKG

SEQ ID NO: 4951 - protein, 15 aa, Artificial Sequence
  Description of Artificial Sequence: Synthetic peptide
DRAYGDYVGWNGFDY

SEQ ID NO: 4952 - protein, 11 aa, Artificial Sequence
  Description of Artificial Sequence: Synthetic peptide
RASQSISSFLA

SEQ ID NO: 4953 - protein, 7 aa, Artificial Sequence
  Description of Artificial Sequence: Synthetic peptide
DASYRAT

SEQ ID NO: 4954 - protein, 9 aa, Artificial Sequence
  Description of Artificial Sequence: Synthetic peptide
QQRGNWPIT

SEQ ID NO: 4955 - protein, 5 aa, Artificial Sequence
  Description of Artificial Sequence: Synthetic peptide
YYDMW

SEQ ID NO: 4956 - protein, 17 aa, Artificial Sequence
  Description of Artificial Sequence: Synthetic peptide
VISSSGGGTFYADSVKG

SEQ ID NO: 4957 - protein, 15 aa, Artificial Sequence
  Description of Artificial Sequence: Synthetic peptide
DRAYGDYVGWNGFDY

SEQ ID NO: 4958 - protein, 11 aa, Artificial Sequence
  Description of Artificial Sequence: Synthetic peptide
RASQSISSFLA

SEQ ID NO: 4959 - protein, 7 aa, Artificial Sequence
  Description of Artificial Sequence: Synthetic peptide
DASYRAT

SEQ ID NO: 4960 - protein, 9 aa, Artificial Sequence
  Description of Artificial Sequence: Synthetic peptide
QQRGNWPIT

SEQ ID NO: 4961 - protein, 5 aa, Artificial Sequence
  Description of Artificial Sequence: Synthetic peptide
YYDMW

SEQ ID NO: 4962 - protein, 17 aa, Artificial Sequence
  Description of Artificial Sequence: Synthetic peptide
VIYPSGGTTFYADSVKG

SEQ ID NO: 4963 - protein, 15 aa, Artificial Sequence
  Description of Artificial Sequence: Synthetic peptide
DRAYGDYVGWNGFDY

SEQ ID NO: 4964 - protein, 11 aa, Artificial Sequence
  Description of Artificial Sequence: Synthetic peptide
RASQSISSFLA

SEQ ID NO: 4965 - protein, 7 aa, Artificial Sequence
  Description of Artificial Sequence: Synthetic peptide
DASYRAT

SEQ ID NO: 4966 - protein, 9 aa, Artificial Sequence
  Description of Artificial Sequence: Synthetic peptide
QQRGNWPIT

SEQ ID NO: 4967 - protein, 5 aa, Artificial Sequence
  Description of Artificial Sequence: Synthetic peptide
YYDMW

SEQ ID NO: 4968 - protein, 17 aa, Artificial Sequence
  Description of Artificial Sequence: Synthetic peptide
VIYPSGGYTAYADSVKG

SEQ ID NO: 4969 - protein, 15 aa, Artificial Sequence
  Description of Artificial Sequence: Synthetic peptide
DRAYGDYVGWNGFDY

SEQ ID NO: 4970 - protein, 11 aa, Artificial Sequence
  Description of Artificial Sequence: Synthetic peptide
RASQSISSFLA

SEQ ID NO: 4971 - protein, 7 aa, Artificial Sequence
  Description of Artificial Sequence: Synthetic peptide
DASYRAT

SEQ ID NO: 4972 - protein, 9 aa, Artificial Sequence
  Description of Artificial Sequence: Synthetic peptide
QQRGNWPIT

SEQ ID NO: 4973 - protein, 5 aa, Artificial Sequence
  Description of Artificial Sequence: Synthetic peptide
YYDMW

SEQ ID NO: 4974 - protein, 17 aa, Artificial Sequence
  Description of Artificial Sequence: Synthetic peptide
YISSSGGGTYYADSVKG

SEQ ID NO: 4975 - protein, 15 aa, Artificial Sequence
  Description of Artificial Sequence: Synthetic peptide
DRAYGDYVGWNGFDY

SEQ ID NO: 4976 - protein, 11 aa, Artificial Sequence
  Description of Artificial Sequence: Synthetic peptide
RASQSISSFLA

SEQ ID NO: 4977 - protein, 7 aa, Artificial Sequence
  Description of Artificial Sequence: Synthetic peptide
DASYRAT

SEQ ID NO: 4978 - protein, 9 aa, Artificial Sequence
  Description of Artificial Sequence: Synthetic peptide
QQRGNWPIT

SEQ ID NO: 4979 - protein, 5 aa, Artificial Sequence
  Description of Artificial Sequence: Synthetic peptide
YYEMW

SEQ ID NO: 4980 - protein, 17 aa, Artificial Sequence
  Description of Artificial Sequence: Synthetic peptide
YISSSGGFTSYADSVKG

SEQ ID NO: 4981 - protein, 15 aa, Artificial Sequence
  Description of Artificial Sequence: Synthetic peptide
DRAYGDYVGWNGFDY

SEQ ID NO: 4982 - protein, 11 aa, Artificial Sequence
  Description of Artificial Sequence: Synthetic peptide
RASQSISSFLA

SEQ ID NO: 4983 - protein, 7 aa, Artificial Sequence
  Description of Artificial Sequence: Synthetic peptide
DASYRAT

SEQ ID NO: 4984 - protein, 9 aa, Artificial Sequence
  Description of Artificial Sequence: Synthetic peptide
QQRGNWPIT

SEQ ID NO: 4985 - protein, 5 aa, Artificial Sequence
  Description of Artificial Sequence: Synthetic peptide
YYGMW

SEQ ID NO: 4986 - protein, 17 aa, Artificial Sequence
  Description of Artificial Sequence: Synthetic peptide
VISPSGGGTFYADSVKG

SEQ ID NO: 4987 - protein, 15 aa, Artificial Sequence
  Description of Artificial Sequence: Synthetic peptide
DRAYGDYVGWNGFDY

SEQ ID NO: 4988 - protein, 11 aa, Artificial Sequence
  Description of Artificial Sequence: Synthetic peptide
RASQSISSFLA

SEQ ID NO: 4989 - protein, 7 aa, Artificial Sequence
  Description of Artificial Sequence: Synthetic peptide
DASYRAT

SEQ ID NO: 4990 - protein, 9 aa, Artificial Sequence
  Description of Artificial Sequence: Synthetic peptide
QQRGNWPIT

SEQ ID NO: 4991 - protein, 5 aa, Artificial Sequence
  Description of Artificial Sequence: Synthetic peptide
YYMMI

SEQ ID NO: 4992 - protein, 17 aa, Artificial Sequence
  Description of Artificial Sequence: Synthetic peptide
GIVSSGGFTMYADSVKG

SEQ ID NO: 4993 - protein, 15 aa, Artificial Sequence
  Description of Artificial Sequence: Synthetic peptide
DRAYGDYVGWNGFDY

SEQ ID NO: 4994 - protein, 11 aa, Artificial Sequence
  Description of Artificial Sequence: Synthetic peptide
RASQSISSFLA

SEQ ID NO: 4995 - protein, 7 aa, Artificial Sequence
  Description of Artificial Sequence: Synthetic peptide
DASYRAT

SEQ ID NO: 4996 - protein, 9 aa, Artificial Sequence
  Description of Artificial Sequence: Synthetic peptide
QQRGNWPIT

SEQ ID NO: 4997 - protein, 5 aa, Artificial Sequence
  Description of Artificial Sequence: Synthetic peptide
YYMMW

SEQ ID NO: 4998 - protein, 17 aa, Artificial Sequence
  Description of Artificial Sequence: Synthetic peptide
SISSSGGGTFYADSVKG

SEQ ID NO: 4999 - protein, 15 aa, Artificial Sequence
  Description of Artificial Sequence: Synthetic peptide
DRAYGDYVGWNGFDY

SEQ ID NO: 5000 - protein, 11 aa, Artificial Sequence
  Description of Artificial Sequence: Synthetic peptide
RASQSISSFLA

SEQ ID NO: 5001 - protein, 7 aa, Artificial Sequence
  Description of Artificial Sequence: Synthetic peptide
DASYRAT

SEQ ID NO: 5002 - protein, 9 aa, Artificial Sequence
  Description of Artificial Sequence: Synthetic peptide
QQRGNWPIT

SEQ ID NO: 5003 - protein, 5 aa, Artificial Sequence
  Description of Artificial Sequence: Synthetic peptide
YYMMW

SEQ ID NO: 5004 - protein, 17 aa, Artificial Sequence
  Description of Artificial Sequence: Synthetic peptide
SIYSSGGATFYADSVKG

SEQ ID NO: 5005 - protein, 15 aa, Artificial Sequence
  Description of Artificial Sequence: Synthetic peptide
DRAYGDYVGWNGFDY

SEQ ID NO: 5006 - protein, 11 aa, Artificial Sequence
  Description of Artificial Sequence: Synthetic peptide
RASQSISSFLA

SEQ ID NO: 5007 - protein, 7 aa, Artificial Sequence
  Description of Artificial Sequence: Synthetic peptide
DASYRAT

SEQ ID NO: 5008 - protein, 9 aa, Artificial Sequence
  Description of Artificial Sequence: Synthetic peptide
QQRGNWPIT

SEQ ID NO: 5009 - protein, 5 aa, Artificial Sequence
  Description of Artificial Sequence: Synthetic peptide
YYNMW

SEQ ID NO: 5010 - protein, 17 aa, Artificial Sequence
  Description of Artificial Sequence: Synthetic peptide
SISPSGGGTYYADSVKG

SEQ ID NO: 5011 - protein, 15 aa, Artificial Sequence
  Description of Artificial Sequence: Synthetic peptide
DRAYGDYVGWNGFDY

SEQ ID NO: 5012 - protein, 11 aa, Artificial Sequence
  Description of Artificial Sequence: Synthetic peptide
RASQSISSFLA

SEQ ID NO: 5013 - protein, 7 aa, Artificial Sequence
  Description of Artificial Sequence: Synthetic peptide
DASYRAT

SEQ ID NO: 5014 - protein, 9 aa, Artificial Sequence
  Description of Artificial Sequence: Synthetic peptide
QQRGNWPIT

SEQ ID NO: 5015 - protein, 5 aa, Artificial Sequence
  Description of Artificial Sequence: Synthetic peptide
YYPMF

SEQ ID NO: 5016 - protein, 17 aa, Artificial Sequence
  Description of Artificial Sequence: Synthetic peptide
YISPSGGWTDYADSVKG

SEQ ID NO: 5017 - protein, 15 aa, Artificial Sequence
  Description of Artificial Sequence: Synthetic peptide
DRAYGDYVGWNGFDY

SEQ ID NO: 5018 - protein, 11 aa, Artificial Sequence
  Description of Artificial Sequence: Synthetic peptide
RASQSISSFLA

SEQ ID NO: 5019 - protein, 7 aa, Artificial Sequence
  Description of Artificial Sequence: Synthetic peptide
DASYRAT

SEQ ID NO: 5020 - protein, 9 aa, Artificial Sequence
  Description of Artificial Sequence: Synthetic peptide
QQRGNWPIT

SEQ ID NO: 5021 - protein, 5 aa, Artificial Sequence
  Description of Artificial Sequence: Synthetic peptide
YYPMI

SEQ ID NO: 5022 - protein, 17 aa, Artificial Sequence
  Description of Artificial Sequence: Synthetic peptide
WISPSGGGTQYADSVKG

SEQ ID NO: 5023 - protein, 15 aa, Artificial Sequence
  Description of Artificial Sequence: Synthetic peptide
DRAYGDYVGWNGFDY

SEQ ID NO: 5024 - protein, 11 aa, Artificial Sequence
  Description of Artificial Sequence: Synthetic peptide
RASQSISSFLA

SEQ ID NO: 5025 - protein, 7 aa, Artificial Sequence
  Description of Artificial Sequence: Synthetic peptide
DASYRAT

SEQ ID NO: 5026 - protein, 9 aa, Artificial Sequence
  Description of Artificial Sequence: Synthetic peptide
QQRGNWPIT

SEQ ID NO: 5027 - protein, 5 aa, Artificial Sequence
  Description of Artificial Sequence: Synthetic peptide
YYPMV

SEQ ID NO: 5028 - protein, 16 aa, Artificial Sequence
  Description of Artificial Sequence: Synthetic peptide
YIWPSGGTYYADSVKG

SEQ ID NO: 5029 - protein, 15 aa, Artificial Sequence
  Description of Artificial Sequence: Synthetic peptide
DRAYGDYVGWNGFDY

SEQ ID NO: 5030 - protein, 11 aa, Artificial Sequence
  Description of Artificial Sequence: Synthetic peptide
RASQSISSFLA

SEQ ID NO: 5031 - protein, 7 aa, Artificial Sequence
  Description of Artificial Sequence: Synthetic peptide
DASYRAT

SEQ ID NO: 5032 - protein, 9 aa, Artificial Sequence
  Description of Artificial Sequence: Synthetic peptide
QQRGNWPIT

SEQ ID NO: 5033 - protein, 5 aa, Artificial Sequence
  Description of Artificial Sequence: Synthetic peptide
YYPMW

SEQ ID NO: 5034 - protein, 17 aa, Artificial Sequence
  Description of Artificial Sequence: Synthetic peptide
SIVPSGGATFYADSVKG

SEQ ID NO: 5035 - protein, 15 aa, Artificial Sequence
  Description of Artificial Sequence: Synthetic peptide
DRAYGDYVGWNGFDY

SEQ ID NO: 5036 - protein, 11 aa, Artificial Sequence
  Description of Artificial Sequence: Synthetic peptide
RASQSISSFLA

SEQ ID NO: 5037 - protein, 7 aa, Artificial Sequence
  Description of Artificial Sequence: Synthetic peptide
DASYRAT

SEQ ID NO: 5038 - protein, 9 aa, Artificial Sequence
  Description of Artificial Sequence: Synthetic peptide
QQRGNWPIT

SEQ ID NO: 5039 - protein, 5 aa, Artificial Sequence
  Description of Artificial Sequence: Synthetic peptide
YYPMW

SEQ ID NO: 5040 - protein, 17 aa, Artificial Sequence
  Description of Artificial Sequence: Synthetic peptide
VIYPSGGATFYADSVKG

SEQ ID NO: 5041 - protein, 15 aa, Artificial Sequence
  Description of Artificial Sequence: Synthetic peptide
DRAYGDYVGWNGFDY

SEQ ID NO: 5042 - protein, 11 aa, Artificial Sequence
  Description of Artificial Sequence: Synthetic peptide
RASQSISSFLA

SEQ ID NO: 5043 - protein, 7 aa, Artificial Sequence
  Description of Artificial Sequence: Synthetic peptide
DASYRAT

SEQ ID NO: 5044 - protein, 9 aa, Artificial Sequence
  Description of Artificial Sequence: Synthetic peptide
QQRGNWPIT

SEQ ID NO: 5045 - protein, 5 aa, Artificial Sequence
  Description of Artificial Sequence: Synthetic peptide
YYPMW

SEQ ID NO: 5046 - protein, 17 aa, Artificial Sequence
  Description of Artificial Sequence: Synthetic peptide
YISSSGGGTHYADSVKG

SEQ ID NO: 5047 - protein, 15 aa, Artificial Sequence
  Description of Artificial Sequence: Synthetic peptide
DRAYGDYVGWNGFDY

SEQ ID NO: 5048 - protein, 11 aa, Artificial Sequence
  Description of Artificial Sequence: Synthetic peptide
RASQSISSFLA

SEQ ID NO: 5049 - protein, 7 aa, Artificial Sequence
  Description of Artificial Sequence: Synthetic peptide
DASYRAT

SEQ ID NO: 5050 - protein, 9 aa, Artificial Sequence
  Description of Artificial Sequence: Synthetic peptide
QQRGNWPIT

SEQ ID NO: 5051 - protein, 5 aa, Artificial Sequence
  Description of Artificial Sequence: Synthetic peptide
YYPMW

SEQ ID NO: 5052 - protein, 17 aa, Artificial Sequence
  Description of Artificial Sequence: Synthetic peptide
YIVPSGGATFYADSVKG

SEQ ID NO: 5053 - protein, 15 aa, Artificial Sequence
  Description of Artificial Sequence: Synthetic peptide
DRAYGDYVGWNGFDY

SEQ ID NO: 5054 - protein, 43 aa, Artificial Sequence
  Description of Artificial Sequence: Synthetic polypeptide
SGFTFSQYPMWWVRQAPGKGLEWVSYIVPSGGRTYYADSVKGR

SEQ ID NO: 5055 - protein, 43 aa, Homo sapiens
SGFTFSSYAMSWVRQAPGKGLEWVSAISGSGGSTYYADSVKGR

SEQ ID NO: 5056 - protein, 43 aa, Artificial Sequence
  Description of Artificial Sequence: Synthetic polypeptide
SGFTFSVYPMIWVRQAPGKGLEWVSYISPSGGFTGYADSVKGR

SEQ ID NO: 5057 - protein, 43 aa, Artificial Sequence
  Description of Artificial Sequence: Synthetic polypeptide
SGFTFSDYPMWWVRQAPGKGLEWVSVIYPSGGATFYADSVKGR

SEQ ID NO: 5058 - protein, 43 aa, Artificial Sequence
  Description of Artificial Sequence: Synthetic polypeptide
SGFTFSTYPMIWVRQAPGKGLEWVSYISPSGGYTGYADSVKGR

SEQ ID NO: 5059 - protein, 43 aa, Artificial Sequence
  Description of Artificial Sequence: Synthetic polypeptide
SGFTFSHYDMWWVRQAPGKGLEWVSVIYSSGGPTFYADSVKGR

SEQ ID NO: 5060 - protein, 43 aa, Artificial Sequence
  Description of Artificial Sequence: Synthetic polypeptide
SGFTFSHYPMWWVRQAPGKGLEWVSSISPSGGATYYADSVKGR

SEQ ID NO: 5061 - protein, 43 aa, Artificial Sequence
  Description of Artificial Sequence: Synthetic polypeptide
SGFTFSKYPMWWVRQAPGKGLEWVSSIYPSGGATFYADSVKGR

SEQ ID NO: 5062 - protein, 43 aa, Artificial Sequence
  Description of Artificial Sequence: Synthetic polypeptide
SGFTFSHYDMLWVRQAPGKGLEWVSYISSSGGYTGYADSVKGR

SEQ ID NO: 5063 - protein, 43 aa, Artificial Sequence
  Description of Artificial Sequence: Synthetic polypeptide
SGFTFSKYPMWWVRQAPGKGLEWVSYISSSGGGTFYADSVKGR

SEQ ID NO: 5064 - protein, 43 aa, Artificial Sequence
  Description of Artificial Sequence: Synthetic polypeptide
SGFTFSLYDMWWVRQAPGKGLEWVSYISSSGGATFYADSVKGR

SEQ ID NO: 5065 - protein, 43 aa, Artificial Sequence
  Description of Artificial Sequence: Synthetic polypeptide
SGFTFSRYPMWWVRQAPGKGLEWVSYISPSGGFTSYADSVKGR

SEQ ID NO: 5066 - protein, 43 aa, Artificial Sequence
  Description of Artificial Sequence: Synthetic polypeptide
SGFTFSTYPMWWVRQAPGKGLEWVSYISSSGGGTYYADSVKGR

SEQ ID NO: 5067 - protein, 43 aa, Artificial Sequence
  Description of Artificial Sequence: Synthetic polypeptide
SGFTFSAYDMIWVRQAPGKGLEWVSYIVPSGGFTDYADSVKGR

SEQ ID NO: 5068 - protein, 43 aa, Artificial Sequence
  Description of Artificial Sequence: Synthetic polypeptide
SGFTFSAYDMWWVRQAPGKGLEWVSVIYPSGGTTFYADSVKGR

SEQ ID NO: 5069 - protein, 43 aa, Artificial Sequence
  Description of Artificial Sequence: Synthetic polypeptide
SGFTFSAYDMWWVRQAPGKGLEWVSVIYSSGGMTLYADSVKGR

SEQ ID NO: 5070 - protein, 43 aa, Artificial Sequence
  Description of Artificial Sequence: Synthetic polypeptide
SGFTFSAYDMWWVRQAPGKGLEWVSYISSSGGFTDYADSVKGR

SEQ ID NO: 5071 - protein, 43 aa, Artificial Sequence
  Description of Artificial Sequence: Synthetic polypeptide
SGFTFSAYEMWWVRQAPGKGLEWVSSIYPSGGYTDYADSVKGR

SEQ ID NO: 5072 - protein, 43 aa, Artificial Sequence
  Description of Artificial Sequence: Synthetic polypeptide
SGFTFSAYEMWWVRQAPGKGLEWVSVIYPSGGGTFYADSVKGR

SEQ ID NO: 5073 - protein, 43 aa, Artificial Sequence
  Description of Artificial Sequence: Synthetic polypeptide
SGFTFSAYMMWWVRQAPGKGLEWVSAISPSGGYTGYADSVKGR

SEQ ID NO: 5074 - protein, 43 aa, Artificial Sequence
  Description of Artificial Sequence: Synthetic polypeptide
SGFTFSAYNMIWVRQAPGKGLEWVSYIVPSGGFTGYADSVKGR

SEQ ID NO: 5075 - protein, 43 aa, Artificial Sequence
  Description of Artificial Sequence: Synthetic polypeptide
SGFTFSAYPMIWVRQAPGKGLEWVSYIVPSGGATFYADSVKGR

SEQ ID NO: 5076 - protein, 43 aa, Artificial Sequence
  Description of Artificial Sequence: Synthetic polypeptide
SGFTFSAYPMMWVRQAPGKGLEWVSYIYPSGGGTFYADSVKGR

SEQ ID NO: 5077 - protein, 43 aa, Artificial Sequence
  Description of Artificial Sequence: Synthetic polypeptide
SGFTFSAYPMWWVRQAPGKGLEWVSYIVPSGGMTYYADSVKGR

SEQ ID NO: 5078 - protein, 43 aa, Artificial Sequence
  Description of Artificial Sequence: Synthetic polypeptide
SGFTFSAYPMWWVRQAPGKGLEWVSYIYPSGGATFYADSVKGR

SEQ ID NO: 5079 - protein, 43 aa, Artificial Sequence
  Description of Artificial Sequence: Synthetic polypeptide
SGFTFSDYAMWWVRQAPGKGLEWVSSIYPSGGATFYADSVKGR

SEQ ID NO: 5080 - protein, 43 aa, Artificial Sequence
  Description of Artificial Sequence: Synthetic polypeptide
SGFTFSDYAMWWVRQAPGKGLEWVSWISPSGGGTLYADSVKGR

SEQ ID NO: 5081 - protein, 43 aa, Artificial Sequence
  Description of Artificial Sequence: Synthetic polypeptide
SGFTFSDYDMFWVRQAPGKGLEWVSGIVSSGGYTGYADSVKGR

SEQ ID NO: 5082 - protein, 43 aa, Artificial Sequence
  Description of Artificial Sequence: Synthetic polypeptide
SGFTFSDYDMWWVRQAPGKGLEWVSVISPSGGYTGYADSVKGR

SEQ ID NO: 5083 - protein, 43 aa, Artificial Sequence
  Description of Artificial Sequence: Synthetic polypeptide
SGFTFSDYDMWWVRQAPGKGLEWVSVIYPSGGFTGYADSVKGR

SEQ ID NO: 5084 - protein, 42 aa, Artificial Sequence
  Description of Artificial Sequence: Synthetic polypeptide
SGFTFSDYDMWWVRQAPGKGLEWVSVIYSGGSTYYADSVKGR

SEQ ID NO: 5085 - protein, 43 aa, Artificial Sequence
  Description of Artificial Sequence: Synthetic polypeptide
SGFTFSDYDMWWVRQAPGKGLEWVSVIYSSGGFTSYADSVKGR

SEQ ID NO: 5086 - protein, 43 aa, Artificial Sequence
  Description of Artificial Sequence: Synthetic polypeptide
SGFTFSDYDMWWVRQAPGKGLEWVSVIYSSGGMTYYADSVKGR

SEQ ID NO: 5087 - protein, 43 aa, Artificial Sequence
  Description of Artificial Sequence: Synthetic polypeptide
SGFTFSDYMMWWVRQAPGKGLEWVSSISPSGGFTDYADSVKGR

SEQ ID NO: 5088 - protein, 43 aa, Artificial Sequence
  Description of Artificial Sequence: Synthetic polypeptide
SGFTFSDYNMWWVRQAPGKGLEWVSVIYPSGGWTMYADSVKGR

SEQ ID NO: 5089 - protein, 43 aa, Artificial Sequence
  Description of Artificial Sequence: Synthetic polypeptide
SGFTFSDYPMFWVRQAPGKGLEWVSYIVPSGGWTDYADSVKGR

SEQ ID NO: 5090 - protein, 43 aa, Artificial Sequence
  Description of Artificial Sequence: Synthetic polypeptide
SGFTFSDYPMFWVRQAPGKGLEWVSYIVPSGGWTSYADSVKGR

SEQ ID NO: 5091 - protein, 43 aa, Artificial Sequence
  Description of Artificial Sequence: Synthetic polypeptide
SGFTFSDYPMIWVRQAPGKGLEWVSYISPSGGYTDYADSVKGR

SEQ ID NO: 5092 - protein, 43 aa, Artificial Sequence
  Description of Artificial Sequence: Synthetic polypeptide
SGFTFSDYPMIWVRQAPGKGLEWVSYIVPSGGWTDYADSVKGR

SEQ ID NO: 5093 - protein, 43 aa, Artificial Sequence
  Description of Artificial Sequence: Synthetic polypeptide
SGFTFSDYPMIWVRQAPGKGLEWVSYIYPSGGGTYYADSVKGR

SEQ ID NO: 5094 - protein, 43 aa, Artificial Sequence
  Description of Artificial Sequence: Synthetic polypeptide
SGFTFSDYPMWWVRQAPGKGLEWVSYISSSGGWTSYADSVKGR

SEQ ID NO: 5095 - protein, 43 aa, Artificial Sequence
  Description of Artificial Sequence: Synthetic polypeptide
SGFTFSDYPMWWVRQAPGKGLEWVSYIYPSGGATYYADSVKGR

SEQ ID NO: 5096 - protein, 43 aa, Artificial Sequence
  Description of Artificial Sequence: Synthetic polypeptide
SGFTFSDYQMWWVRQAPGKGLEWVSVIYPSGGATFYADSVKGR

SEQ ID NO: 5097 - protein, 43 aa, Artificial Sequence
  Description of Artificial Sequence: Synthetic polypeptide
SGFTFSEYDMWWVRQAPGKGLEWVSVIYPSGGPTYYADSVKGR

SEQ ID NO: 5098 - protein, 43 aa, Artificial Sequence
  Description of Artificial Sequence: Synthetic polypeptide
SGFTFSEYDMWWVRQAPGKGLEWVSVIYSSGGYTGYADSVKGR

SEQ ID NO: 5099 - protein, 43 aa, Artificial Sequence
  Description of Artificial Sequence: Synthetic polypeptide
SGFTFSEYEMWWVRQAPGKGLEWVSVIYPSGGYTNYADSVKGR

SEQ ID NO: 5100 - protein, 43 aa, Artificial Sequence
  Description of Artificial Sequence: Synthetic polypeptide
SGFTFSEYNMWWVRQAPGKGLEWVSVIYPSGGPTWYADSVKGR

SEQ ID NO: 5101 - protein, 43 aa, Artificial Sequence
  Description of Artificial Sequence: Synthetic polypeptide
SGFTFSEYPMFWVRQAPGKGLEWVSYISPSGGWTSYADSVKGR

SEQ ID NO: 5102 - protein, 43 aa, Artificial Sequence
  Description of Artificial Sequence: Synthetic polypeptide
SGFTFSEYPMIWVRQAPGKGLEWVSYISPSGGYTGYADSVKGR

SEQ ID NO: 5103 - protein, 43 aa, Artificial Sequence
  Description of Artificial Sequence: Synthetic polypeptide
SGFTFSEYPMWWVRQAPGKGLEWVSSIYPSGGATFYADSVKGR

SEQ ID NO: 5104 - protein, 43 aa, Artificial Sequence
  Description of Artificial Sequence: Synthetic polypeptide
SGFTFSEYWMWWVRQAPGKGLEWVSSISPSGGGTFYADSVKGR

SEQ ID NO: 5105 - protein, 43 aa, Artificial Sequence
  Description of Artificial Sequence: Synthetic polypeptide
SGFTFSFYDMFWVRQAPGKGLEWVSVISSSGGGTFYADSVKGR

SEQ ID NO: 5106 - protein, 43 aa, Artificial Sequence
  Description of Artificial Sequence: Synthetic polypeptide
SGFTFSFYDMLWVRQAPGKGLEWVSYISSSGGFTGYADSVKGR

SEQ ID NO: 5107 - protein, 43 aa, Artificial Sequence
  Description of Artificial Sequence: Synthetic polypeptide
SGFTFSFYDMWWVRQAPGKGLEWVSSIYSSGGATFYADSVKGR

SEQ ID NO: 5108 - protein, 43 aa, Artificial Sequence
  Description of Artificial Sequence: Synthetic polypeptide
SGFTFSFYDMWWVRQAPGKGLEWVSVIYSSGGATFYADSVKGR

SEQ ID NO: 5109 - protein, 43 aa, Artificial Sequence
  Description of Artificial Sequence: Synthetic polypeptide
SGFTFSFYDMWWVRQAPGKGLEWVSVIYSSGGFTDYADSVKGR

SEQ ID NO: 5110 - protein, 43 aa, Artificial Sequence
  Description of Artificial Sequence: Synthetic polypeptide
SGFTFSFYDMWWVRQAPGKGLEWVSYISSSGGGTFYADSVKGR

SEQ ID NO: 5111 - protein, 43 aa, Artificial Sequence
  Description of Artificial Sequence: Synthetic polypeptide
SGFTFSFYDMYWVRQAPGKGLEWVSSIVPSGGATFYADSVKGR

SEQ ID NO: 5112 - protein, 43 aa, Artificial Sequence
  Description of Artificial Sequence: Synthetic polypeptide
SGFTFSFYEMWWVRQAPGKGLEWVSYISPSGGGTYYADSVKGR

SEQ ID NO: 5113 - protein, 42 aa, Artificial Sequence
  Description of Artificial Sequence: Synthetic polypeptide
SGFTFSFYHMIWVRQAPGKGLEWVSYIYSSGGTFYADSVKGR

SEQ ID NO: 5114 - protein, 43 aa, Artificial Sequence
  Description of Artificial Sequence: Synthetic polypeptide
SGFTFSFYMMWWVRQAPGKGLEWVSSISPSGGATFYADSVKGR

SEQ ID NO: 5115 - protein, 43 aa, Artificial Sequence
  Description of Artificial Sequence: Synthetic polypeptide
SGFTFSFYNMWWVRQAPGKGLEWVSSISPSGGGTFYADSVKGR

SEQ ID NO: 5116 - protein, 43 aa, Artificial Sequence
  Description of Artificial Sequence: Synthetic polypeptide
SGFTFSFYNMWWVRQAPGKGLEWVSVIYPSGGKTYYADSVKGR

SEQ ID NO: 5117 - protein, 43 aa, Artificial Sequence
  Description of Artificial Sequence: Synthetic polypeptide
SGFTFSFYNMWWVRQAPGKGLEWVSVIYPSGGPTFYADSVKGR

SEQ ID NO: 5118 - protein, 43 aa, Artificial Sequence
  Description of Artificial Sequence: Synthetic polypeptide
SGFTFSFYPMIWVRQAPGKGLEWVSYISPSGGSTLYADSVKGR

SEQ ID NO: 5119 - protein, 43 aa, Artificial Sequence
  Description of Artificial Sequence: Synthetic polypeptide
SGFTFSFYPMIWVRQAPGKGLEWVSYISSSGGFTDYADSVKGR

SEQ ID NO: 5120 - protein, 43 aa, Artificial Sequence
  Description of Artificial Sequence: Synthetic polypeptide
SGFTFSFYPMIWVRQAPGKGLEWVSYISSSGGYTSYADSVKGR

SEQ ID NO: 5121 - protein, 41 aa, Artificial Sequence
  Description of Artificial Sequence: Synthetic polypeptide
SGFTFSFYPMLWVRQAPGKGLEWVSYISGGYTGYADSVKGR

SEQ ID NO: 5122 - protein, 43 aa, Artificial Sequence
  Description of Artificial Sequence: Synthetic polypeptide
SGFTFSFYPMMWVRQAPGKGLEWVSYISFSGGYTGYADSVKGR

SEQ ID NO: 5123 - protein, 43 aa, Artificial Sequence
  Description of Artificial Sequence: Synthetic polypeptide
SGFTFSFYPMWWVRQAPGKGLEWVSYIYPSGGATFYADSVKGR

SEQ ID NO: 5124 - protein, 43 aa, Artificial Sequence
  Description of Artificial Sequence: Synthetic polypeptide
SGFTFSGYDMWWVRQAPGKGLEWVSVISPSGGGTFYADSVKGR

SEQ ID NO: 5125 - protein, 43 aa, Artificial Sequence
  Description of Artificial Sequence: Synthetic polypeptide
SGFTFSGYDMWWVRQAPGKGLEWVSVIYSSGGTTFYADSVKGR

SEQ ID NO: 5126 - protein, 43 aa, Artificial Sequence
  Description of Artificial Sequence: Synthetic polypeptide
SGFTFSGYNMWWVRQAPGKGLEWVSVIYPSGGATFYADSVKGR

SEQ ID NO: 5127 - protein, 43 aa, Artificial Sequence
  Description of Artificial Sequence: Synthetic polypeptide
SGFTFSGYPMWWVRQAPGKGLEWVSYISSSGGGTFYADSVKGR

SEQ ID NO: 5128 - protein, 43 aa, Artificial Sequence
  Description of Artificial Sequence: Synthetic polypeptide
SGFTFSHYAMIWVRQAPGKGLEWVSYIVPSGGWTDYADSVKGR

SEQ ID NO: 5129 - protein, 43 aa, Artificial Sequence
  Description of Artificial Sequence: Synthetic polypeptide
SGFTFSHYAMIWVRQAPGKGLEWVSYIVPSGGWTGYADSVKGR

SEQ ID NO: 5130 - protein, 43 aa, Artificial Sequence
  Description of Artificial Sequence: Synthetic polypeptide
SGFTFSHYDMWWVRQAPGKGLEWVSSISPSGGATFYADSVKGR

SEQ ID NO: 5131 - protein, 42 aa, Artificial Sequence
  Description of Artificial Sequence: Synthetic polypeptide
SGFTFSHYDMWWVRQAPGKGLEWVSVIVSSGKTFYADSVKGR

SEQ ID NO: 5132 - protein, 43 aa, Artificial Sequence
  Description of Artificial Sequence: Synthetic polypeptide
SGFTFSHYDMWWVRQAPGKGLEWVSVIYPSGGFTDYADSVKGR

SEQ ID NO: 5133 - protein, 43 aa, Artificial Sequence
  Description of Artificial Sequence: Synthetic polypeptide
SGFTFSHYDMWWVRQAPGKGLEWVSVIYPSGGHTLYADSVKGR

SEQ ID NO: 5134 - protein, 43 aa, Artificial Sequence
  Description of Artificial Sequence: Synthetic polypeptide
SGFTFSHYDMWWVRQAPGKGLEWVSVIYPSGGPTYYADSVKGR

SEQ ID NO: 5135 - protein, 43 aa, Artificial Sequence
  Description of Artificial Sequence: Synthetic polypeptide
SGFTFSHYDMWWVRQAPGKGLEWVSVIYPSGGVTYYADSVKGR

SEQ ID NO: 5136 - protein, 43 aa, Artificial Sequence
  Description of Artificial Sequence: Synthetic polypeptide
SGFTFSHYDMWWVRQAPGKGLEWVSVIYSSGGFTGYADSVKGR

SEQ ID NO: 5137 - protein, 43 aa, Artificial Sequence
  Description of Artificial Sequence: Synthetic polypeptide
SGFTFSHYDMWWVRQAPGKGLEWVSVIYSSGGPTYYADSVKGR

SEQ ID NO: 5138 - protein, 43 aa, Artificial Sequence
  Description of Artificial Sequence: Synthetic polypeptide
SGFTFSHYDMWWVRQAPGKGLEWVSYISPSGGFTSYADSVKGR

SEQ ID NO: 5139 - protein, 43 aa, Artificial Sequence
  Description of Artificial Sequence: Synthetic polypeptide
SGFTFSHYEMWWVRQAPGKGLEWVSSISSSGGGTFYADSVKGR

SEQ ID NO: 5140 - protein, 43 aa, Artificial Sequence
  Description of Artificial Sequence: Synthetic polypeptide
SGFTFSHYEMWWVRQAPGKGLEWVSYIGSSGGSTYYADSVKGR

SEQ ID NO: 5141 - protein, 43 aa, Artificial Sequence
  Description of Artificial Sequence: Synthetic polypeptide
SGFTFSHYMMIWVRQAPGKGLEWVSGISPSGGYTGYADSVKGR

SEQ ID NO: 5142 - protein, 43 aa, Artificial Sequence
  Description of Artificial Sequence: Synthetic polypeptide
SGFTFSHYMMWWVRQAPGKGLEWVSSIYPSGGGTYYADSVKGR

SEQ ID NO: 5143 - protein, 42 aa, Artificial Sequence
  Description of Artificial Sequence: Synthetic polypeptide
SGFTFSHYMMWWVRQAPGKGLEWVSSIYPSGGTYYADSVKGR

SEQ ID NO: 5144 - protein, 43 aa, Artificial Sequence
  Description of Artificial Sequence: Synthetic polypeptide
SGFTFSHYPMFWVRQAPGKGLEWVSYISSSGGWTDYADSVKGR

SEQ ID NO: 5145 - protein, 43 aa, Artificial Sequence
  Description of Artificial Sequence: Synthetic polypeptide
SGFTFSHYPMIWVRQAPGKGLEWVSYISPSGGGTFYADSVKGR

SEQ ID NO: 5146 - protein, 43 aa, Artificial Sequence
  Description of Artificial Sequence: Synthetic polypeptide
SGFTFSHYPMIWVRQAPGKGLEWVSYISSSGGGTFYADSVKGR

SEQ ID NO: 5147 - protein, 43 aa, Artificial Sequence
  Description of Artificial Sequence: Synthetic polypeptide
SGFTFSHYPMIWVRQAPGKGLEWVSYIYSSGGGTFYADSVKGR

SEQ ID NO: 5148 - protein, 43 aa, Artificial Sequence
  Description of Artificial Sequence: Synthetic polypeptide
SGFTFSHYPMLWVRQAPGKGLEWVSYIYPSGGGTFYADSVKGR

SEQ ID NO: 5149 - protein, 43 aa, Artificial Sequence
  Description of Artificial Sequence: Synthetic polypeptide
SGFTFSHYPMMWVRQAPGKGLEWVSYISSSGGYTGYADSVKGR

SEQ ID NO: 5150 - protein, 43 aa, Artificial Sequence
  Description of Artificial Sequence: Synthetic polypeptide
SGFTFSHYPMMWVRQAPGKGLEWVSYIYSSGGGTYYADSVKGR

SEQ ID NO: 5151 - protein, 43 aa, Artificial Sequence
  Description of Artificial Sequence: Synthetic polypeptide
SGFTFSHYPMVWVRQAPGKGLEWVSYISPSGGYTGYADSVKGR

SEQ ID NO: 5152 - protein, 43 aa, Artificial Sequence
  Description of Artificial Sequence: Synthetic polypeptide
SGFTFSHYPMWWVRQAPGKGLEWVSSISPSGGATFYADSVKGR

SEQ ID NO: 5153 - protein, 43 aa, Artificial Sequence
  Description of Artificial Sequence: Synthetic polypeptide
SGFTFSHYPMWWVRQAPGKGLEWVSVIYSSGGGTFYADSVKGR

SEQ ID NO: 5154 - protein, 43 aa, Artificial Sequence
  Description of Artificial Sequence: Synthetic polypeptide
SGFTFSHYPMWWVRQAPGKGLEWVSWIVPSGGFTLYADSVKGR

SEQ ID NO: 5155 - protein, 43 aa, Artificial Sequence
  Description of Artificial Sequence: Synthetic polypeptide
SGFTFSHYPMWWVRQAPGKGLEWVSYIHPSGGGTLYADSVKGR

SEQ ID NO: 5156 - protein, 43 aa, Artificial Sequence
  Description of Artificial Sequence: Synthetic polypeptide
SGFTFSHYPMWWVRQAPGKGLEWVSYISSSGGGTFYADSVKGR

SEQ ID NO: 5157 - protein, 43 aa, Artificial Sequence
  Description of Artificial Sequence: Synthetic polypeptide
SGFTFSHYPMWWVRQAPGKGLEWVSYIVPSGGATFYADSVKGR

SEQ ID NO: 5158 - protein, 43 aa, Artificial Sequence
  Description of Artificial Sequence: Synthetic polypeptide
SGFTFSHYPMWWVRQAPGKGLEWVSYIYPSGGGTYYADSVKGR

SEQ ID NO: 5159 - protein, 43 aa, Artificial Sequence
  Description of Artificial Sequence: Synthetic polypeptide
SGFTFSHYQMWWVRQAPGKGLEWVSSISSSGGGTYYADSVKGR

SEQ ID NO: 5160 - protein, 43 aa, Artificial Sequence
  Description of Artificial Sequence: Synthetic polypeptide
SGFTFSHYSMMWVRQDPGKGLEWVSYISPSGGYTGYADSVKGR

SEQ ID NO: 5161 - protein, 43 aa, Artificial Sequence
  Description of Artificial Sequence: Synthetic polypeptide
SGFTFSHYSMWWVRQAPGKGLEWVSVIYPSGGATFYADSVKGR

SEQ ID NO: 5162 - protein, 43 aa, Artificial Sequence
  Description of Artificial Sequence: Synthetic polypeptide
SGFTFSIYDMWWVRQAPGKGLEWVSVISPSGGSTYYADSVKGR

SEQ ID NO: 5163 - protein, 43 aa, Artificial Sequence
  Description of Artificial Sequence: Synthetic polypeptide
SGFTFSIYDMWWVRQAPGKGLEWVSVIYPSGGATWYADSVKGR

SEQ ID NO: 5164 - protein, 43 aa, Artificial Sequence
  Description of Artificial Sequence: Synthetic polypeptide
SGFTFSIYDMWWVRQAPGKGLEWVSVIYPSGGPTFYADSVKGR

SEQ ID NO: 5165 - protein, 43 aa, Artificial Sequence
  Description of Artificial Sequence: Synthetic polypeptide
SGFTFSIYDMWWVRQAPGKGLEWVSVIYPSGGVTFYADSVKGR

SEQ ID NO: 5166 - protein, 43 aa, Artificial Sequence
  Description of Artificial Sequence: Synthetic polypeptide
SGFTFSIYDMWWVRQAPGKGLEWVSVIYSSGGFTGYADSVKGR

SEQ ID NO: 5167 - protein, 43 aa, Artificial Sequence
  Description of Artificial Sequence: Synthetic polypeptide
SGFTFSIYPMIWVRQAPGKGLEWVSYISPSGGYTSYADSVKGR

SEQ ID NO: 5168 - protein, 43 aa, Artificial Sequence
  Description of Artificial Sequence: Synthetic polypeptide
SGFTFSIYPMWWVRQAPGKGLEWVSYISPSGGFTSYADSVKGR

SEQ ID NO: 5169 - protein, 43 aa, Artificial Sequence
  Description of Artificial Sequence: Synthetic polypeptide
SGFTFSIYPMWWVRQAPGKGLEWVSYISPSGGGTYYADSVKGR

SEQ ID NO: 5170 - protein, 43 aa, Artificial Sequence
  Description of Artificial Sequence: Synthetic polypeptide
SGFTFSIYPMWWVRQAPGKGLEWVSYISSSGGWTDYADSVKGR

SEQ ID NO: 5171 - protein, 43 aa, Artificial Sequence
  Description of Artificial Sequence: Synthetic polypeptide
SGFTFSIYPMWWVRQAPGKGLEWVSYIVPSGGMTYYADSVKGR

SEQ ID NO: 5172 - protein, 43 aa, Artificial Sequence
  Description of Artificial Sequence: Synthetic polypeptide
SGFTFSIYPMWWVRQAPGKGLEWVSYIYPSGGGTFYADSVKGR

SEQ ID NO: 5173 - protein, 43 aa, Artificial Sequence
  Description of Artificial Sequence: Synthetic polypeptide
SGFTFSKYAMIWVRQAPGKGLEWVSWIPPSGGYTSYADSVKGR

SEQ ID NO: 5174 - protein, 43 aa, Artificial Sequence
  Description of Artificial Sequence: Synthetic polypeptide
SGFTFSKYAMIWVRQAPGKGLEWVSYISPSGGFTGYADSVKGR

SEQ ID NO: 5175 - protein, 43 aa, Artificial Sequence
  Description of Artificial Sequence: Synthetic polypeptide
SGFTFSKYAMIWVRQSPGKGLEWVSYISSSGGFTDYADSVKGR

SEQ ID NO: 5176 - protein, 43 aa, Artificial Sequence
  Description of Artificial Sequence: Synthetic polypeptide
SGFTFSKYAMWWVRQAPGKGLEWVSSISPSGGGTFYADSVKGR

SEQ ID NO: 5177 - protein, 43 aa, Artificial Sequence
  Description of Artificial Sequence: Synthetic polypeptide
SGFTFSKYAMWWVRQAPGKGLEWVSYIVPSGGRTFYADSVKGR

SEQ ID NO: 5178 - protein, 43 aa, Artificial Sequence
  Description of Artificial Sequence: Synthetic polypeptide
SGFTFSKYDMFWVRQAPGKGLEWVSSIVPSGGATYYADSVKGR

SEQ ID NO: 5179 - protein, 43 aa, Artificial Sequence
  Description of Artificial Sequence: Synthetic polypeptide
SGFTFSKYDMIWVRQAPGKGLEWVSWIGPSGGATMYADSVKGR

SEQ ID NO: 5180 - protein, 43 aa, Artificial Sequence
  Description of Artificial Sequence: Synthetic polypeptide
SGFTFSKYDMIWVRQAPGKGLEWVSYIGSSGGYTGYADSVKGR

SEQ ID NO: 5181 - protein, 43 aa, Artificial Sequence
  Description of Artificial Sequence: Synthetic polypeptide
SGFTFSKYDMWWVRQAPGKGLEWVSSISSSGGGTFYADSVKGR

SEQ ID NO: 5182 - protein, 43 aa, Artificial Sequence
  Description of Artificial Sequence: Synthetic polypeptide
SGFTFSKYDMWWVRQAPGKGLEWVSVIYPSGGPTFYADSVKGR

SEQ ID NO: 5183 - protein, 43 aa, Artificial Sequence
  Description of Artificial Sequence: Synthetic polypeptide
SGFTFSKYDMWWVRQAPGKGLEWVSVIYPSGGQTYYADSVKGR

SEQ ID NO: 5184 - protein, 43 aa, Artificial Sequence
  Description of Artificial Sequence: Synthetic polypeptide
SGFTFSKYDMWWVRQAPGKGLEWVSVIYPSGGSTYYADSVKGR

SEQ ID NO: 5185 - protein, 43 aa, Artificial Sequence
  Description of Artificial Sequence: Synthetic polypeptide
SGFTFSKYDMWWVRQAPGKGLEWVSVIYSSGGFTLYADSVKGR

SEQ ID NO: 5186 - protein, 43 aa, Artificial Sequence
  Description of Artificial Sequence: Synthetic polypeptide
SGFTFSKYDMWWVRQAPGKGLEWVSVIYSSGGFTSYADSVKGR

SEQ ID NO: 5187 - protein, 43 aa, Artificial Sequence
  Description of Artificial Sequence: Synthetic polypeptide
SGFTFSKYDMWWVRQAPGKGLEWVSVIYSSGGPTFYADSVKGR

SEQ ID NO: 5188 - protein, 43 aa, Artificial Sequence
  Description of Artificial Sequence: Synthetic polypeptide
SGFTFSKYDMWWVRQAPGKGLEWVSYIGPSGGFTDYADSVKGR

SEQ ID NO: 5189 - protein, 43 aa, Artificial Sequence
  Description of Artificial Sequence: Synthetic polypeptide
SGFTFSKYDMWWVRQAPGKGLEWVSYISSSGGFTDYADSVKGR

SEQ ID NO: 5190 - protein, 43 aa, Artificial Sequence
  Description of Artificial Sequence: Synthetic polypeptide
SGFTFSKYDMWWVRQAPGKGLEWVSYIVPSGGFIDYADSVKGR

SEQ ID NO: 5191 - protein, 43 aa, Artificial Sequence
  Description of Artificial Sequence: Synthetic polypeptide
SGFTFSKYEMFWVRQAPGKGLEWVSSISSSGGGTFYADSVKGR

SEQ ID NO: 5192 - protein, 43 aa, Artificial Sequence
  Description of Artificial Sequence: Synthetic polypeptide
SGFTFSKYEMWWVRQAPGKGLEWVSVIYPSGGMTYYADSVKGR

SEQ ID NO: 5193 - protein, 43 aa, Artificial Sequence
  Description of Artificial Sequence: Synthetic polypeptide
SGFTFSKYEMWWVRQAPGKGLEWVSVIYPSGGYTGYADSVKGR

SEQ ID NO: 5194 - protein, 43 aa, Artificial Sequence
  Description of Artificial Sequence: Synthetic polypeptide
SGFTFSKYEMWWVRQAPGKGLEWVSVIYSSGGKTYYADSVKGR

SEQ ID NO: 5195 - protein, 43 aa, Artificial Sequence
  Description of Artificial Sequence: Synthetic polypeptide
SGFTFSKYEMWWVRQAPGKGLEWVSYIGPSGGFTDYADSVKGR

SEQ ID NO: 5196 - protein, 43 aa, Artificial Sequence
  Description of Artificial Sequence: Synthetic polypeptide
SGFTFSKYEMWWVRQAPGKGLEWVSYIGPSGGITMYADSVKGR

SEQ ID NO: 5197 - protein, 43 aa, Artificial Sequence
  Description of Artificial Sequence: Synthetic polypeptide
SGFTFSKYEMWWVRQAPGKGLEWVSYISPSGGGTLYADSVKGR

SEQ ID NO: 5198 - protein, 43 aa, Artificial Sequence
  Description of Artificial Sequence: Synthetic polypeptide
SGFTFSKYMMFWVRQAPGKGLEWVSSIYSSGGRTFYADSVKGR

SEQ ID NO: 5199 - protein, 43 aa, Artificial Sequence
  Description of Artificial Sequence: Synthetic polypeptide
SGFTFSKYNMWWVRQAPGKGLEWVSSIYPSGGATFYADSVKGR

SEQ ID NO: 5200 - protein, 43 aa, Artificial Sequence
  Description of Artificial Sequence: Synthetic polypeptide
SGFTFSKYNMWWVRQAPGKGLEWVSVIYPSGGATFYADSVKGR

SEQ ID NO: 5201 - protein, 43 aa, Artificial Sequence
  Description of Artificial Sequence: Synthetic polypeptide
SGFTFSKYPMFWVRQAPGKGLEWVSYIVPSGGYTSYADSVKGR

SEQ ID NO: 5202 - protein, 43 aa, Artificial Sequence
  Description of Artificial Sequence: Synthetic polypeptide
SGFTFSKYPMIWVRQAPGKGLEWVSYISPSGGYTGYADSVKGR

SEQ ID NO: 5203 - protein, 43 aa, Artificial Sequence
  Description of Artificial Sequence: Synthetic polypeptide
SGFTFSKYPMIWVRQAPGKGLEWVSYISPSGGYTSYADSVKGR

SEQ ID NO: 5204 - protein, 43 aa, Artificial Sequence
  Description of Artificial Sequence: Synthetic polypeptide
SGFTFSKYPMIWVRQAPGKGLEWVSYISSSGGWTDYADSVKGR

SEQ ID NO: 5205 - protein, 43 aa, Artificial Sequence
  Description of Artificial Sequence: Synthetic polypeptide
SGFTFSKYPMIWVRQAPGKGLEWVSYIYPSGGATYYADSVKGR

SEQ ID NO: 5206 - protein, 43 aa, Artificial Sequence
  Description of Artificial Sequence: Synthetic polypeptide
SGFTFSKYPMIWVRQAPGKGLEWVSYIYPSGGYTSYADSVKGR

SEQ ID NO: 5207 - protein, 43 aa, Artificial Sequence
  Description of Artificial Sequence: Synthetic polypeptide
SGFTFSKYPMIWVRQAPGKGLEWVSYIYSSGGGTYYADSVKGR

SEQ ID NO: 5208 - protein, 43 aa, Artificial Sequence
  Description of Artificial Sequence: Synthetic polypeptide
SGFTFSKYPMMWVRQAPGKGLEWVSYISPSGGFTDYADSVKGR

SEQ ID NO: 5209 - protein, 43 aa, Artificial Sequence
  Description of Artificial Sequence: Synthetic polypeptide
SGFTFSKYPMMWVRQAPGKGLEWVSYIYPSGGYTDYADSVKGR

SEQ ID NO: 5210 - protein, 43 aa, Artificial Sequence
  Description of Artificial Sequence: Synthetic polypeptide
SGFTFSKYPMMWVRQAPGKGLEWVSYIYPSGGYTGYADSVKGR

SEQ ID NO: 5211 - protein, 43 aa, Artificial Sequence
  Description of Artificial Sequence: Synthetic polypeptide
SGFTFSKYPMWWVRQAPGKGLEWVSSIVSSGGATYYTDSVKGR

SEQ ID NO: 5212 - protein, 43 aa, Artificial Sequence
  Description of Artificial Sequence: Synthetic polypeptide
SGFTFSKYPMWWVRQAPGKGLEWVSSIYPSGGYTGYADSVKGR

SEQ ID NO: 5213 - protein, 43 aa, Artificial Sequence
  Description of Artificial Sequence: Synthetic polypeptide
SGFTFSKYPMWWVRQAPGKGLEWVSVISPSGGATYYADSVKGR

SEQ ID NO: 5214 - protein, 43 aa, Artificial Sequence
  Description of Artificial Sequence: Synthetic polypeptide
SGFTFSKYPMWWVRQAPGKGLEWVSVIYPSGGYTAYADSVKGR

SEQ ID NO: 5215 - protein, 43 aa, Artificial Sequence
  Description of Artificial Sequence: Synthetic polypeptide
SGFTFSKYPMWWVRQAPGKGLEWVSVIYSSGGGTFYADSVKGR

SEQ ID NO: 5216 - protein, 43 aa, Artificial Sequence
  Description of Artificial Sequence: Synthetic polypeptide
SGFTFSKYPMWWVRQAPGKGLEWVSYISPSGGGTLYADSVKGR

SEQ ID NO: 5217 - protein, 43 aa, Artificial Sequence
  Description of Artificial Sequence: Synthetic polypeptide
SGFTFSKYPMWWVRQAPGKGLEWVSYISPSGGGTYYADSVKGR

SEQ ID NO: 5218 - protein, 43 aa, Artificial Sequence
  Description of Artificial Sequence: Synthetic polypeptide
SGFTFSKYPMWWVRQAPGKGLEWVSYISSSGGGTYYADSVKGR

SEQ ID NO: 5219 - protein, 43 aa, Artificial Sequence
  Description of Artificial Sequence: Synthetic polypeptide
SGFTFSKYPMWWVRQAPGKGLEWVSYIVPSGGATFYADSVKGR

SEQ ID NO: 5220 - protein, 43 aa, Artificial Sequence
  Description of Artificial Sequence: Synthetic polypeptide
SGFTFSKYPMWWVRQAPGKGLEWVSYIVPSGGPTWYADSVKGR

SEQ ID NO: 5221 - protein, 43 aa, Artificial Sequence
  Description of Artificial Sequence: Synthetic polypeptide
SGFTFSKYPMWWVRQAPGKGLEWVSYIVPSGGWTAYADSVKGR

SEQ ID NO: 5222 - protein, 43 aa, Artificial Sequence
  Description of Artificial Sequence: Synthetic polypeptide
SGFTFSKYQMWWVRQAPGKGLEWVSSIYPSGGATFYADSVKGR

SEQ ID NO: 5223 - protein, 43 aa, Artificial Sequence
  Description of Artificial Sequence: Synthetic polypeptide
SGFTFSKYQMWWVRQAPGKGLEWVSSIYPSGGGTFYADSVKGR

SEQ ID NO: 5224 - protein, 43 aa, Artificial Sequence
  Description of Artificial Sequence: Synthetic polypeptide
SGFTFSKYSMIWVRQAPGKGLEWVSYIVPSGGYTGYADSVKGR

SEQ ID NO: 5225 - protein, 43 aa, Artificial Sequence
  Description of Artificial Sequence: Synthetic polypeptide
SGFTFSKYSMWWVRQAPGKGLEWVSSIYPSGGATFYADSVKGR

SEQ ID NO: 5226 - protein, 43 aa, Artificial Sequence
  Description of Artificial Sequence: Synthetic polypeptide
SGFTFSKYSMWWVRQAPGKGLEWVSVIYPSGGATFYADSVKGR

SEQ ID NO: 5227 - protein, 43 aa, Artificial Sequence
  Description of Artificial Sequence: Synthetic polypeptide
SGFTFSKYSMWWVRQAPGKGLEWVSVIYPSGGFTDYADSVKGR

SEQ ID NO: 5228 - protein, 43 aa, Artificial Sequence
  Description of Artificial Sequence: Synthetic polypeptide
SGFTFSKYTMWWVRQAPGKGLEWVSVIYPSGGATFYADSVKGR

SEQ ID NO: 5229 - protein, 43 aa, Artificial Sequence
  Description of Artificial Sequence: Synthetic polypeptide
SGFTFSKYWMWWVRQAPGKGLEWVSVIVPSGGMTYYADSVKGR

SEQ ID NO: 5230 - protein, 43 aa, Artificial Sequence
  Description of Artificial Sequence: Synthetic polypeptide
SGFTFSKYYMWWVRQAPGKGLEWVSSIYSSGGGTFYADSVKGR

SEQ ID NO: 5231 - protein, 43 aa, Artificial Sequence
  Description of Artificial Sequence: Synthetic polypeptide
SGFTFSLYAMIWVRQAPGKGLEWVSYISPSGGFTGYADSVKGR

SEQ ID NO: 5232 - protein, 43 aa, Artificial Sequence
  Description of Artificial Sequence: Synthetic polypeptide
SGFTFSLYAMWWVRQAPGKGLEWVSSIVPSGGKTYYADSVKGR

SEQ ID NO: 5233 - protein, 43 aa, Artificial Sequence
  Description of Artificial Sequence: Synthetic polypeptide
SGFTFSLYAMWWVRQAPGKGLEWVSYIYPSGGGTYYADSVKGR

SEQ ID NO: 5234 - protein, 43 aa, Artificial Sequence
  Description of Artificial Sequence: Synthetic polypeptide
SGFTFSLYDMLWVRQAPGKGLEWVSYIYPSGGFTGYADSVKGR

SEQ ID NO: 5235 - protein, 43 aa, Artificial Sequence
  Description of Artificial Sequence: Synthetic polypeptide
SGFTFSLYDMVWVRQAPGKGLEWVSWIGPSGGLTIYADSVKGR

SEQ ID NO: 5236 - protein, 43 aa, Artificial Sequence
  Description of Artificial Sequence: Synthetic polypeptide
SGFTFSLYDMWWVRQAPGKGLEWVSSISSSGGYTGYADSVKGR

SEQ ID NO: 5237 - protein, 43 aa, Artificial Sequence
  Description of Artificial Sequence: Synthetic polypeptide
SGFTFSLYDMWWVRQAPGKGLEWVSVIRPSGGSTYYADSVKGR

SEQ ID NO: 5238 - protein, 43 aa, Artificial Sequence
  Description of Artificial Sequence: Synthetic polypeptide
SGFTFSLYDMWWVRQAPGKGLEWVSVIYPSGGPTYYADSVKGR

SEQ ID NO: 5239 - protein, 43 aa, Artificial Sequence
  Description of Artificial Sequence: Synthetic polypeptide
SGFTFSLYDMWWVRQAPGKGLEWVSVIYSSGGATFYADSVKGR

SEQ ID NO: 5240 - protein, 43 aa, Artificial Sequence
  Description of Artificial Sequence: Synthetic polypeptide
SGFTFSLYDMWWVRQAPGKGLEWVSVIYSSGGTTFYADSVKGR

SEQ ID NO: 5241 - protein, 43 aa, Artificial Sequence
  Description of Artificial Sequence: Synthetic polypeptide
SGFTFSLYDMWWVRQAPGKGLEWVSVIYSSGGYTAYADSVKGR

SEQ ID NO: 5242 - protein, 43 aa, Artificial Sequence
  Description of Artificial Sequence: Synthetic polypeptide
SGFTFSLYDMWWVRQAPGKGLEWVSVIYSSGGYTGYADSVKGR

SEQ ID NO: 5243 - protein, 43 aa, Artificial Sequence
  Description of Artificial Sequence: Synthetic polypeptide
SGFTFSLYDMWWVRQAPGKGLEWVSYIGPSGGNTLYADSVKGR

SEQ ID NO: 5244 - protein, 43 aa, Artificial Sequence
  Description of Artificial Sequence: Synthetic polypeptide
SGFTFSLYEMWWVRQAPGKGLEWVSVISPSGGGTYYADSVKGR

SEQ ID NO: 5245 - protein, 43 aa, Artificial Sequence
  Description of Artificial Sequence: Synthetic polypeptide
SGFTFSLYEMWWVRQAPGKGLEWVSYISSSGGGTLYADSVKGR

SEQ ID NO: 5246 - protein, 42 aa, Artificial Sequence
  Description of Artificial Sequence: Synthetic polypeptide
SGFTFSLYMMWWVRKAPGKGLEWVSSIYPSGGTYYADSVKGR

SEQ ID NO: 5247 - protein, 43 aa, Artificial Sequence
  Description of Artificial Sequence: Synthetic polypeptide
SGFTFSLYNMWWVRQAPGKGLEWVSVIYPSGGYTGYADSVKGR

SEQ ID NO: 5248 - protein, 43 aa, Artificial Sequence
  Description of Artificial Sequence: Synthetic polypeptide
SGFTFSLYPMIWVRQAPGKGLEWVSYISPSGGFTDYADSVKGR

SEQ ID NO: 5249 - protein, 43 aa, Artificial Sequence
  Description of Artificial Sequence: Synthetic polypeptide
SGFTFSLYPMMWVRQAPGKGLEWVSYIYPSGGGTFYADSVKGR

SEQ ID NO: 5250 - protein, 43 aa, Artificial Sequence
  Description of Artificial Sequence: Synthetic polypeptide
SGFTFSLYPMWWVRQAPGKGLEWVSSISPSGGATFYADSVKGR

SEQ ID NO: 5251 - protein, 43 aa, Artificial Sequence
  Description of Artificial Sequence: Synthetic polypeptide
SGFTFSLYPMWWVRQAPGKGLEWVSSISPSGGGTFYADSVKGR

SEQ ID NO: 5252 - protein, 43 aa, Artificial Sequence
  Description of Artificial Sequence: Synthetic polypeptide
SGFTFSLYPMWWVRQAPGKGLEWVSSIYPSGGATFYADSVKGR

SEQ ID NO: 5253 - protein, 43 aa, Artificial Sequence
  Description of Artificial Sequence: Synthetic polypeptide
SGFTFSLYPMWWVRQAPGKGLEWVSVIYSSGGATFYADSVKGR

SEQ ID NO: 5254 - protein, 43 aa, Artificial Sequence
  Description of Artificial Sequence: Synthetic polypeptide
SGFTFSLYPMWWVRQAPGKGLEWVSWIVPSGGFTLYADSVKGR

SEQ ID NO: 5255 - protein, 43 aa, Artificial Sequence
  Description of Artificial Sequence: Synthetic polypeptide
SGFTFSLYPMWWVRQAPGKGLEWVSYISPSGGGTLYADSVKGR

SEQ ID NO: 5256 - protein, 43 aa, Artificial Sequence
  Description of Artificial Sequence: Synthetic polypeptide
SGFTFSLYPMWWVRQAPGKGLEWVSYISSSGGGTYYADSVKGR

SEQ ID NO: 5257 - protein, 43 aa, Artificial Sequence
  Description of Artificial Sequence: Synthetic polypeptide
SGFTFSLYPMWWVRQAPGKGLEWVSYIVPSGGGTFYADSVKGR

SEQ ID NO: 5258 - protein, 43 aa, Artificial Sequence
  Description of Artificial Sequence: Synthetic polypeptide
SGFTFSLYPMWWVRQAPGKGLEWVSYIVSSGGATFYADSVKGR

SEQ ID NO: 5259 - protein, 43 aa, Artificial Sequence
  Description of Artificial Sequence: Synthetic polypeptide
SGFTFSLYPMWWVRQAPGKGLEWVSYIYPSGGATMYADSVKGR

SEQ ID NO: 5260 - protein, 43 aa, Artificial Sequence
  Description of Artificial Sequence: Synthetic polypeptide
SGFTFSLYQMWWVRQAPGKGLEWVSVIYPSGGATYYADSVKGR

SEQ ID NO: 5261 - protein, 42 aa, Artificial Sequence
  Description of Artificial Sequence: Synthetic polypeptide
SGFTFSLYQMWWVRQAPGKGLEWVSVIYPSGGTFYADSVKGR

SEQ ID NO: 5262 - protein, 43 aa, Artificial Sequence
  Description of Artificial Sequence: Synthetic polypeptide
SGFTFSMYDMWWVRQAPGKGLEWVSVISPSGGGTFYADSVKGR

SEQ ID NO: 5263 - protein, 43 aa, Artificial Sequence
  Description of Artificial Sequence: Synthetic polypeptide
SGFTFSMYDMWWVRQAPGKGLEWVSVIYPSGGNTLYADSVKGR

SEQ ID NO: 5264 - protein, 43 aa, Artificial Sequence
  Description of Artificial Sequence: Synthetic polypeptide
SGFTFSMYDMWWVRQAPGKGLEWVSVIYPSGGPTFYADSVKGR

SEQ ID NO: 5265 - protein, 43 aa, Artificial Sequence
  Description of Artificial Sequence: Synthetic polypeptide
SGFTFSMYDMWWVRQAPGKGLEWVSVIYPSGGYTAYADSVKGR

SEQ ID NO: 5266 - protein, 43 aa, Artificial Sequence
  Description of Artificial Sequence: Synthetic polypeptide
SGFTFSMYDMWWVRQAPGKGLEWVSVIYSSGGFTDYADSVKGR

SEQ ID NO: 5267 - protein, 43 aa, Artificial Sequence
  Description of Artificial Sequence: Synthetic polypeptide
SGFTFSMYDMWWVRQAPGKGLEWVSVIYSSGGPTFYADSVKGR

SEQ ID NO: 5268 - protein, 43 aa, Artificial Sequence
  Description of Artificial Sequence: Synthetic polypeptide
SGFTFSMYDMWWVRQAPGKGLEWVSVIYSSGGVTFYADSVKGR

SEQ ID NO: 5269 - protein, 43 aa, Artificial Sequence
  Description of Artificial Sequence: Synthetic polypeptide
SGFTFSMYDMWWVRQAPGKGLEWVSVIYSSGGYTAYADSVKGR

SEQ ID NO: 5270 - protein, 43 aa, Artificial Sequence
  Description of Artificial Sequence: Synthetic polypeptide
SGFTFSMYDMWWVRQAPGKGLEWVSVIYSSGGYTDYADSVKGR

SEQ ID NO: 5271 - protein, 43 aa, Artificial Sequence
  Description of Artificial Sequence: Synthetic polypeptide
SGFTFSMYDMWWVRQAPGKGLEWVSVIYSSGGYTNYADSVKGR

SEQ ID NO: 5272 - protein, 43 aa, Artificial Sequence
  Description of Artificial Sequence: Synthetic polypeptide
SGFTFSMYDMWWVRQAPGKGLEWVSVIYSSGGYTSYADSVKGR

SEQ ID NO: 5273 - protein, 43 aa, Artificial Sequence
  Description of Artificial Sequence: Synthetic polypeptide
SGFTFSMYDMWWVRQAPGKGLEWVSYISSSGGSTLYADSVKGR

SEQ ID NO: 5274 - protein, 43 aa, Artificial Sequence
  Description of Artificial Sequence: Synthetic polypeptide
SGFTFSMYMMIWVRQAPGKGLEWVSSIYPSGGFTSYADSVKGR

SEQ ID NO: 5275 - protein, 43 aa, Artificial Sequence
  Description of Artificial Sequence: Synthetic polypeptide
SGFTFSMYNMWWVRQAPGKGLEWVSSISPSGGATYYADSVKGR

SEQ ID NO: 5276 - protein, 43 aa, Artificial Sequence
  Description of Artificial Sequence: Synthetic polypeptide
SGFTFSMYPIIWVRQAPGKGLEWVSYISPSGGFTGYADSVKGR

SEQ ID NO: 5277 - protein, 43 aa, Artificial Sequence
  Description of Artificial Sequence: Synthetic polypeptide
SGFTFSMYPMFWVRQAPGKGLEWVSYISPSGGWTAYADSVKGR

SEQ ID NO: 5278 - protein, 43 aa, Artificial Sequence
  Description of Artificial Sequence: Synthetic polypeptide
SGFTFSMYPMFWVRQAPGKGLEWVSYISPSGGWTDYADSVKGR

SEQ ID NO: 5279 - protein, 43 aa, Artificial Sequence
  Description of Artificial Sequence: Synthetic polypeptide
SGFTFSMYPMFWVRQAPGKGLEWVSYIVPSGGWTDYADSVKGR

SEQ ID NO: 5280 - protein, 43 aa, Artificial Sequence
  Description of Artificial Sequence: Synthetic polypeptide
SGFTFSMYPMIWVRQAPGKGLEWVSYISPSGGGTFYADSVKGR

SEQ ID NO: 5281 - protein, 43 aa, Artificial Sequence
  Description of Artificial Sequence: Synthetic polypeptide
SGFTFSMYPMIWVRQAPGKGLEWVSYIVPSGGFTGYADSVKGR

SEQ ID NO: 5282 - protein, 43 aa, Artificial Sequence
  Description of Artificial Sequence: Synthetic polypeptide
SGFTFSMYPMLWVRQAPGKGLEWVSYISPSGGYTGYADSVKGR

SEQ ID NO: 5283 - protein, 43 aa, Artificial Sequence
  Description of Artificial Sequence: Synthetic polypeptide
SGFTFSMYPMTWVRQAPGKGLEWVSYISPSGGYTGYADSVKGR

SEQ ID NO: 5284 - protein, 43 aa, Artificial Sequence
  Description of Artificial Sequence: Synthetic polypeptide
SGFTFSMYSMWWVRQAPGKGLEWVSVIYPSGGFTDYADSVKGR

SEQ ID NO: 5285 - protein, 43 aa, Artificial Sequence
  Description of Artificial Sequence: Synthetic polypeptide
SGFTFSMYWMLWVRQAPGKGLEWVSYISPSGGGTFYADSVKGR

SEQ ID NO: 5286 - protein, 43 aa, Artificial Sequence
  Description of Artificial Sequence: Synthetic polypeptide
SGFTFSMYWMWWVRQAPGKGLEWVSSISSSGGYTGYADSVKGR

SEQ ID NO: 5287 - protein, 42 aa, Artificial Sequence
  Description of Artificial Sequence: Synthetic polypeptide
SGFTFSNYAMWWVRQAPGKGLEWVSYISPSGATYYADSVKGR

SEQ ID NO: 5288 - protein, 43 aa, Artificial Sequence
  Description of Artificial Sequence: Synthetic polypeptide
SGFTFSNYAMWWVRQAPGKGLEWVSYISPSGGSTYYADSVKGR

SEQ ID NO: 5289 - protein, 43 aa, Artificial Sequence
  Description of Artificial Sequence: Synthetic polypeptide
SGFTFSNYDMAWVRQAPGKGLEWVSWISSSGGFTDYADSVKGR

SEQ ID NO: 5290 - protein, 43 aa, Artificial Sequence
  Description of Artificial Sequence: Synthetic polypeptide
SGFTFSNYDMIWVRQAPGKGLEWVSVISPSGGWTSYADSVKGR

SEQ ID NO: 5291 - protein, 43 aa, Artificial Sequence
  Description of Artificial Sequence: Synthetic polypeptide
SGFTFSNYDMIWVRQAPGKGLEWVSYIVPSGGYTAYADSVKGR

SEQ ID NO: 5292 - protein, 43 aa, Artificial Sequence
  Description of Artificial Sequence: Synthetic polypeptide
SGFTFSNYDMWWVRQAPGKGLEWVSVISPSGGFTGYADSVKGR

SEQ ID NO: 5293 - protein, 43 aa, Artificial Sequence
  Description of Artificial Sequence: Synthetic polypeptide
SGFTFSNYDMWWVRQAPGKGLEWVSVISSSGGYTGYADSVKGR

SEQ ID NO: 5294 - protein, 42 aa, Artificial Sequence
  Description of Artificial Sequence: Synthetic polypeptide
SGFTFSNYDMWWVRQAPGKGLEWVSVISSSGMTYYADSVKGR

SEQ ID NO: 5295 - protein, 43 aa, Artificial Sequence
  Description of Artificial Sequence: Synthetic polypeptide
SGFTFSNYDMWWVRQAPGKGLEWVSVIVPSGGATYYADSVKGR

SEQ ID NO: 5296 - protein, 43 aa, Artificial Sequence
  Description of Artificial Sequence: Synthetic polypeptide
SGFTFSNYDMWWVRQAPGKGLEWVSVIYPSGGATFYADSVKGR

SEQ ID NO: 5297 - protein, 43 aa, Artificial Sequence
  Description of Artificial Sequence: Synthetic polypeptide
SGFTFSNYDMWWVRQAPGKGLEWVSVIYPSGGITYYADSVKGR

SEQ ID NO: 5298 - protein, 43 aa, Artificial Sequence
  Description of Artificial Sequence: Synthetic polypeptide
SGFTFSNYDMWWVRQAPGKGLEWVSVIYPSGGPTYYADSVKGR

SEQ ID NO: 5299 - protein, 43 aa, Artificial Sequence
  Description of Artificial Sequence: Synthetic polypeptide
SGFTFSNYDMWWVRQAPGKGLEWVSVIYPSGGYTVYADSVKGR

SEQ ID NO: 5300 - protein, 43 aa, Artificial Sequence
  Description of Artificial Sequence: Synthetic polypeptide
SGFTFSNYDMWWVRQAPGKGLEWVSVIYSSGGPTYYADSVKGR

SEQ ID NO: 5301 - protein, 43 aa, Artificial Sequence
  Description of Artificial Sequence: Synthetic polypeptide
SGFTFSNYDMWWVRQAPGKGLEWVSVIYSSGGYTAYADSVKGR

SEQ ID NO: 5302 - protein, 43 aa, Artificial Sequence
  Description of Artificial Sequence: Synthetic polypeptide
SGFTFSNYDMWWVRQAPGKGLEWVSWISSSGGATIYADSVKGR

SEQ ID NO: 5303 - protein, 43 aa, Artificial Sequence
  Description of Artificial Sequence: Synthetic polypeptide
SGFTFSNYDMWWVRQAPGKGLEWVSYISSSGGATLYADSVKGR

SEQ ID NO: 5304 - protein, 43 aa, Artificial Sequence
  Description of Artificial Sequence: Synthetic polypeptide
SGFTFSNYEMWWVRQAPGKGLEWVSVIYSSGSATFYADSVKGR

SEQ ID NO: 5305 - protein, 43 aa, Artificial Sequence
  Description of Artificial Sequence: Synthetic polypeptide
SGFTFSNYIMWWVRQAPGKGLEWVSSIYPSGGATLYADSVKGR

SEQ ID NO: 5306 - protein, 43 aa, Artificial Sequence
  Description of Artificial Sequence: Synthetic polypeptide
SGFTFSNYMMIWVRQAPGKGLEWVSSIYPSGGYTGYADSVKGR

SEQ ID NO: 5307 - protein, 43 aa, Artificial Sequence
  Description of Artificial Sequence: Synthetic polypeptide
SGFTFSNYMMIWVRQAPGKGLEWVSSIYSSGGFTSYADSVKGR

SEQ ID NO: 5308 - protein, 43 aa, Artificial Sequence
  Description of Artificial Sequence: Synthetic polypeptide
SGFTFSNYMMWWVRQAPGKGLEWVSSIGPSGGGTFYADSVKGR

SEQ ID NO: 5309 - protein, 43 aa, Artificial Sequence
  Description of Artificial Sequence: Synthetic polypeptide
SGFTFSNYMMWWVRQAPGKGLEWVSSIYSSGGGTFYADSVKGR

SEQ ID NO: 5310 - protein, 43 aa, Artificial Sequence
  Description of Artificial Sequence: Synthetic polypeptide
SGFTFSNYMMWWVRQAPGKGLEWVSVISPSGGATYYADSVKGR

SEQ ID NO: 5311 - protein, 43 aa, Artificial Sequence
  Description of Artificial Sequence: Synthetic polypeptide
SGFTFSNYNMMWVRQAPGKGLEWVSYISSSGGYTGYADSVKGR

SEQ ID NO: 5312 - protein, 43 aa, Artificial Sequence
  Description of Artificial Sequence: Synthetic polypeptide
SGFTFSNYNMWWVRQAPGKGLEWVSVIYPSGGPTFYADSVKGR

SEQ ID NO: 5313 - protein, 43 aa, Artificial Sequence
  Description of Artificial Sequence: Synthetic polypeptide
SGFTFSNYNMWWVRQAPGKGLEWVSYISPSGGGTLYADSVKGR

SEQ ID NO: 5314 - protein, 43 aa, Artificial Sequence
  Description of Artificial Sequence: Synthetic polypeptide
SGFTFSNYPMFWVRQAPGKGLEWVSYISPSGGWTSYADSVKGR

SEQ ID NO: 5315 - protein, 43 aa, Artificial Sequence
  Description of Artificial Sequence: Synthetic polypeptide
SGFTFSNYPMIWVRQAPGKGLEWVSYISPSGGGTFYADSVKGR

SEQ ID NO: 5316 - protein, 43 aa, Artificial Sequence
  Description of Artificial Sequence: Synthetic polypeptide
SGFTFSNYPMIWVRQAPGKGLEWVSYISSSGGYTGYADSVKGR

SEQ ID NO: 5317 - protein, 43 aa, Artificial Sequence
  Description of Artificial Sequence: Synthetic polypeptide
SGFTFSNYPMIWVRQAPGKGLEWVSYIVPSGGFTSYADSVKGR

SEQ ID NO: 5318 - protein, 43 aa, Artificial Sequence
  Description of Artificial Sequence: Synthetic polypeptide
SGFTFSNYPMIWVRQAPGKGLEWVSYIYPSGGGTYYADSVKGR

SEQ ID NO: 5319 - protein, 42 aa, Artificial Sequence
  Description of Artificial Sequence: Synthetic polypeptide
SGFTFSNYPMIWVRQAPGKGLEWVSYIYPSGGTFYADSVKGR

SEQ ID NO: 5320 - protein, 43 aa, Artificial Sequence
  Description of Artificial Sequence: Synthetic polypeptide
SGFTFSNYPMWWVRQAPGKGLEWVSSISPSGGSTYYADSVKGR

SEQ ID NO: 5321 - protein, 43 aa, Artificial Sequence
  Description of Artificial Sequence: Synthetic polypeptide
SGFTFSNYPMWWVRQAPGKGLEWVSSIVPSGGATYYADSVKGR

SEQ ID NO: 5322 - protein, 43 aa, Artificial Sequence
  Description of Artificial Sequence: Synthetic polypeptide
SGFTFSNYPMWWVRQAPGKGLEWVSSIYPSGGATFYADSVKGR

SEQ ID NO: 5323 - protein, 44 aa, Artificial Sequence
  Description of Artificial Sequence: Synthetic polypeptide
SGFTFSNYPMWWVRQAPGKGLEWVSSIYPSGGKATYYADSVKGR

SEQ ID NO: 5324 - protein, 43 aa, Artificial Sequence
  Description of Artificial Sequence: Synthetic polypeptide
SGFTFSNYPMWWVRQAPGKGLEWVSSIYPSGGPTFYADSVKGR

SEQ ID NO: 5325 - protein, 43 aa, Artificial Sequence
  Description of Artificial Sequence: Synthetic polypeptide
SGFTFSNYPMWWVRQAPGKGLEWVSSIYSSGGATFYADSVKGR

SEQ ID NO: 5326 - protein, 43 aa, Artificial Sequence
  Description of Artificial Sequence: Synthetic polypeptide
SGFTFSNYPMWWVRQAPGKGLEWVSVIYPSGGYTAYADSVKGR

SEQ ID NO: 5327 - protein, 43 aa, Artificial Sequence
  Description of Artificial Sequence: Synthetic polypeptide
SGFTFSNYPMWWVRQAPGKGLEWVSYIGPSGGGTLYADSVKGR

SEQ ID NO: 5328 - protein, 43 aa, Artificial Sequence
  Description of Artificial Sequence: Synthetic polypeptide
SGFTFSNYPMWWVRQAPGKGLEWVSYIRPSGGPTWYADSVKGR

SEQ ID NO: 5329 - protein, 43 aa, Artificial Sequence
  Description of Artificial Sequence: Synthetic polypeptide
SGFTFSNYPMWWVRQAPGKGLEWVSYISPSGGGTFYADSVKGR

SEQ ID NO: 5330 - protein, 43 aa, Artificial Sequence
  Description of Artificial Sequence: Synthetic polypeptide
SGFTFSNYPMWWVRQAPGKGLEWVSYISPSGGGTLYADSVKGR

SEQ ID NO: 5331 - protein, 43 aa, Artificial Sequence
  Description of Artificial Sequence: Synthetic polypeptide
SGFTFSNYPMWWVRQAPGKGLEWVSYIVPSGGATFYADSVKGR

SEQ ID NO: 5332 - protein, 43 aa, Artificial Sequence
  Description of Artificial Sequence: Synthetic polypeptide
SGFTFSNYPMWWVRQAPGKGLEWVSYIVPSGGMTYYADSVKGR

SEQ ID NO: 5333 - protein, 43 aa, Artificial Sequence
  Description of Artificial Sequence: Synthetic polypeptide
SGFTFSNYSMWWVRQAPGKGLEWVSVIYPSGGYTSYADSVKGR

SEQ ID NO: 5334 - protein, 43 aa, Artificial Sequence
  Description of Artificial Sequence: Synthetic polypeptide
SGFTFSNYYMIWVRQAPGKGLEWVSYISPSGGGTYYADSVKGR

SEQ ID NO: 5335 - protein, 43 aa, Artificial Sequence
  Description of Artificial Sequence: Synthetic polypeptide
SGFTFSPYAMWWVRQAPGKGLEWVSYISSSGGGTFYADSVKGR

SEQ ID NO: 5336 - protein, 43 aa, Artificial Sequence
  Description of Artificial Sequence: Synthetic polypeptide
SGFTFSPYDMWWVRQAPGKGLEWVSVISPSGGATFYADSVKGR

SEQ ID NO: 5337 - protein, 43 aa, Artificial Sequence
  Description of Artificial Sequence: Synthetic polypeptide
SGFTFSPYDMWWVRQAPGKGLEWVSVISPSGGYTGYADSVKGR

SEQ ID NO: 5338 - protein, 43 aa, Artificial Sequence
  Description of Artificial Sequence: Synthetic polypeptide
SGFTFSPYDMWWVRQAPGKGLEWVSVISSSGGFTDYADSVKGR

SEQ ID NO: 5339 - protein, 43 aa, Artificial Sequence
  Description of Artificial Sequence: Synthetic polypeptide
SGFTFSPYMMFWVRQAPGKGLEWVSSISSSGGGTFYADSVKGR

SEQ ID NO: 5340 - protein, 43 aa, Artificial Sequence
  Description of Artificial Sequence: Synthetic polypeptide
SGFTFSPYMMIWVRQAPGKGLEWVSSISSSGGYTGYADSVKGR

SEQ ID NO: 5341 - protein, 43 aa, Artificial Sequence
  Description of Artificial Sequence: Synthetic polypeptide
SGFTFSPYMMSWVRQAPGKGLEWVSSIYSSGGATFYADSVKGR

SEQ ID NO: 5342 - protein, 43 aa, Artificial Sequence
  Description of Artificial Sequence: Synthetic polypeptide
SGFTFSPYMMWWVRQAPGKGLEWVSSISSSGGGTFYADSVKGR

SEQ ID NO: 5343 - protein, 43 aa, Artificial Sequence
  Description of Artificial Sequence: Synthetic polypeptide
SGFTFSPYNMWWVRQAPGKGLEWVSVIYPSGGATFYADSVKGR

SEQ ID NO: 5344 - protein, 43 aa, Artificial Sequence
  Description of Artificial Sequence: Synthetic polypeptide
SGFTFSPYPMFWVRQAPGKGLEWVSSISPSGGATYYADSVKGR

SEQ ID NO: 5345 - protein, 43 aa, Artificial Sequence
  Description of Artificial Sequence: Synthetic polypeptide
SGFTFSPYPMIWVRQAPGKGLEWVSYIGSSGGYTSYADSVKGR

SEQ ID NO: 5346 - protein, 43 aa, Artificial Sequence
  Description of Artificial Sequence: Synthetic polypeptide
SGFTFSPYPMIWVRQAPGKGLEWVSYISPSGGFTDYADSVKGR

SEQ ID NO: 5347 - protein, 43 aa, Artificial Sequence
  Description of Artificial Sequence: Synthetic polypeptide
SGFTFSPYPMIWVRQAPGKGLEWVSYISPSGGGTFYADSVKGR

SEQ ID NO: 5348 - protein, 43 aa, Artificial Sequence
  Description of Artificial Sequence: Synthetic polypeptide
SGFTFSPYPMIWVRQAPGKGLEWVSYISSSGGGTYYADSVKGR

SEQ ID NO: 5349 - protein, 43 aa, Artificial Sequence
  Description of Artificial Sequence: Synthetic polypeptide
SGFTFSPYPMIWVRQAPGKGLEWVSYISSSGGYTDYADSVKGR

SEQ ID NO: 5350 - protein, 43 aa, Artificial Sequence
  Description of Artificial Sequence: Synthetic polypeptide
SGFTFSPYPMWWVRQAPGKGLEWVSYISPSGGWTDYADSVKGR

SEQ ID NO: 5351 - protein, 43 aa, Artificial Sequence
  Description of Artificial Sequence: Synthetic polypeptide
SGFTFSPYPMWWVRQAPGKGLEWVSYIVPSGGKTFYADSVKGR

SEQ ID NO: 5352 - protein, 43 aa, Artificial Sequence
  Description of Artificial Sequence: Synthetic polypeptide
SGFTFSQYAMIWVRQAPGKGLEWVSYISPSGGYTGYADSVKGR

SEQ ID NO: 5353 - protein, 43 aa, Artificial Sequence
  Description of Artificial Sequence: Synthetic polypeptide
SGFTFSQYDMIWVRQAPGKGLEWVSYIGSSGGSTIYADSVKGR

SEQ ID NO: 5354 - protein, 43 aa, Artificial Sequence
  Description of Artificial Sequence: Synthetic polypeptide
SGFTFSQYDMWWFRQAPGKGLEWVSVISPSGGHTSYADSVKGR

SEQ ID NO: 5355 - protein, 43 aa, Artificial Sequence
  Description of Artificial Sequence: Synthetic polypeptide
SGFTFSQYDMWWVRQAPGKGLEWVSVISSSGGATWYADSVKGR

SEQ ID NO: 5356 - protein, 43 aa, Artificial Sequence
  Description of Artificial Sequence: Synthetic polypeptide
SGFTFSQYDMWWVRQAPGKGLEWVSVIYPSGGPTFYADSVKGR

SEQ ID NO: 5357 - protein, 43 aa, Artificial Sequence
  Description of Artificial Sequence: Synthetic polypeptide
SGFTFSQYDMWWVRQAPGKGLEWVSVIYPSGGTTFYADSVKGR

SEQ ID NO: 5358 - protein, 43 aa, Artificial Sequence
  Description of Artificial Sequence: Synthetic polypeptide
SGFTFSQYDMWWVRQAPGKGLEWVSVIYPSGGYTDYADSVKGR

SEQ ID NO: 5359 - protein, 42 aa, Artificial Sequence
  Description of Artificial Sequence: Synthetic polypeptide
SGFTFSQYDMWWVRQAPGKGLEWVSVIYPSGTTFYADSVKGR

SEQ ID NO: 5360 - protein, 43 aa, Artificial Sequence
  Description of Artificial Sequence: Synthetic polypeptide
SGFTFSQYDMWWVRQAPGKGLEWVSYIVPSGGFTDYADSVKGR

SEQ ID NO: 5361 - protein, 43 aa, Artificial Sequence
  Description of Artificial Sequence: Synthetic polypeptide
SGFTFSQYGMWWVRQAPGKGLEWVSYIYPSGGGTYYADSVKGR

SEQ ID NO: 5362 - protein, 43 aa, Artificial Sequence
  Description of Artificial Sequence: Synthetic polypeptide
SGFTFSQYMMIWVRQAPGKGLEWVSYIVPSGGTTGYADSVKGR

SEQ ID NO: 5363 - protein, 43 aa, Artificial Sequence
  Description of Artificial Sequence: Synthetic polypeptide
SGFTFSQYPMFWVRQAPGKGLEWVSYIVPSGGYTSYADSVKGR

SEQ ID NO: 5364 - protein, 43 aa, Artificial Sequence
  Description of Artificial Sequence: Synthetic polypeptide
SGFTFSQYPMIWVRQAPGKGLEWVSYIVPSGGWTSYADSVKGR

SEQ ID NO: 5365 - protein, 43 aa, Artificial Sequence
  Description of Artificial Sequence: Synthetic polypeptide
SGFTFSQYPMMWVRQAPGKGLEWVSYIYPSGGATYYADSVKGR

SEQ ID NO: 5366 - protein, 43 aa, Artificial Sequence
  Description of Artificial Sequence: Synthetic polypeptide
SGFTFSQYPMMWVRQAPGKGLEWVSYIYPSGGGTYYADSVKGR

SEQ ID NO: 5367 - protein, 43 aa, Artificial Sequence
  Description of Artificial Sequence: Synthetic polypeptide
SGFTFSQYPMWWVRQAPGKGLEWVSSISPSGGATYYADSVKGR

SEQ ID NO: 5368 - protein, 43 aa, Artificial Sequence
  Description of Artificial Sequence: Synthetic polypeptide
SGFTFSQYPMWWVRQAPGKGLEWVSSIYPSGGGTFYADSVKGR

SEQ ID NO: 5369 - protein, 43 aa, Artificial Sequence
  Description of Artificial Sequence: Synthetic polypeptide
SGFTFSQYPMWWVRQAPGKGLEWVSSIYSSGGATYYADSVKGR

SEQ ID NO: 5370 - protein, 43 aa, Artificial Sequence
  Description of Artificial Sequence: Synthetic polypeptide
SGFTFSQYPMWWVRQAPGKGLEWVSVIYPSGGFTSYADSVKGR

SEQ ID NO: 5371 - protein, 43 aa, Artificial Sequence
  Description of Artificial Sequence: Synthetic polypeptide
SGFTFSQYPMWWVRQAPGKGLEWVSVIYPSGGYTGYADSVKGR

SEQ ID NO: 5372 - protein, 43 aa, Artificial Sequence
  Description of Artificial Sequence: Synthetic polypeptide
SGFTFSQYQMWWVRQAPGKGLEWVSVIYPSGGATYYADSVKGR

SEQ ID NO: 5373 - protein, 43 aa, Artificial Sequence
  Description of Artificial Sequence: Synthetic polypeptide
SGFTFSQYSMIWVRQAPGKGLEWVSYIVPSGGYTSYADSVKGR

SEQ ID NO: 5374 - protein, 43 aa, Artificial Sequence
  Description of Artificial Sequence: Synthetic polypeptide
SGFTFSQYSMWWVRQAPGKGLEWVSSIVPSGGATFYADSVKGR

SEQ ID NO: 5375 - protein, 43 aa, Artificial Sequence
  Description of Artificial Sequence: Synthetic polypeptide
SGFTFSQYSMWWVRQAPGKGLEWVSVIYSSGGATFYADSVKGR

SEQ ID NO: 5376 - protein, 43 aa, Artificial Sequence
  Description of Artificial Sequence: Synthetic polypeptide
SGFTFSQYSMWWVRQAPGKGLEWVSVIYSSGSATFYADSVKGR

SEQ ID NO: 5377 - protein, 43 aa, Artificial Sequence
  Description of Artificial Sequence: Synthetic polypeptide
SGFTFSQYWMWWVRQAPGKGLEWVSVISSSGGGTYYADSVKGR

SEQ ID NO: 5378 - protein, 43 aa, Artificial Sequence
  Description of Artificial Sequence: Synthetic polypeptide
SGFTFSQYWMWWVRQAPGKGLEWVSVIVPSGGKTFYADSVKGR

SEQ ID NO: 5379 - protein, 43 aa, Artificial Sequence
  Description of Artificial Sequence: Synthetic polypeptide
SGFTFSRYAMIWVRQAPGKGLEWVSYISPSGGFTDYADSVKGR

SEQ ID NO: 5380 - protein, 43 aa, Artificial Sequence
  Description of Artificial Sequence: Synthetic polypeptide
SGFTFSRYAMMWVRQAPGKGLEWVSYISPSGGFTDYADSVKGR

SEQ ID NO: 5381 - protein, 43 aa, Artificial Sequence
  Description of Artificial Sequence: Synthetic polypeptide
SGFTFSRYAMWWVRQAPGKGLEWVSSIYPSGGGTFYADSVKGR

SEQ ID NO: 5382 - protein, 43 aa, Artificial Sequence
  Description of Artificial Sequence: Synthetic polypeptide
SGFTFSRYAMWWVRQAPGKGLEWVSYIVPSGGYTDYADSVKGR

SEQ ID NO: 5383 - protein, 43 aa, Artificial Sequence
  Description of Artificial Sequence: Synthetic polypeptide
SGFTFSRYDMFWVRQAPGKGLEWVSSISPSGGGTYYADSVKGR

SEQ ID NO: 5384 - protein, 43 aa, Artificial Sequence
  Description of Artificial Sequence: Synthetic polypeptide
SGFTFSRYDMWWVRQAPGKGLEWVSSISSSGGFTGYADSVKGR

SEQ ID NO: 5385 - protein, 43 aa, Artificial Sequence
  Description of Artificial Sequence: Synthetic polypeptide
SGFTFSRYDMWWVRQAPGKGLEWVSVISPSGGATFYADSVKGR

SEQ ID NO: 5386 - protein, 43 aa, Artificial Sequence
  Description of Artificial Sequence: Synthetic polypeptide
SGFTFSRYDMWWVRQAPGKGLEWVSVIYPSGGHTMYADSVKGR

SEQ ID NO: 5387 - protein, 43 aa, Artificial Sequence
  Description of Artificial Sequence: Synthetic polypeptide
SGFTFSRYDMWWVRQAPGKGLEWVSWISPSGGGTQYADSVKGR

SEQ ID NO: 5388 - protein, 43 aa, Artificial Sequence
  Description of Artificial Sequence: Synthetic polypeptide
SGFTFSRYDMWWVRQAPGKGLEWVSYIVPSGGFTSYADSVKGR

SEQ ID NO: 5389 - protein, 43 aa, Artificial Sequence
  Description of Artificial Sequence: Synthetic polypeptide
SGFTFSRYHMWWVRQAPGKGLEWVSYISPSGGSTLYADSVKGR

SEQ ID NO: 5390 - protein, 43 aa, Artificial Sequence
  Description of Artificial Sequence: Synthetic polypeptide
SGFTFSRYMMIWVRQAPGKGLEWVSGIYPSGGWTDYADSVKGR

SEQ ID NO: 5391 - protein, 43 aa, Artificial Sequence
  Description of Artificial Sequence: Synthetic polypeptide
SGFTFSRYNMWWVRQAPGKGLEWVSVIYPSGGATYYADSVKGR

SEQ ID NO: 5392 - protein, 43 aa, Artificial Sequence
  Description of Artificial Sequence: Synthetic polypeptide
SGFTFSRYPMFWVRQAPGKGLEWVSYISPSGGYTSYADSVKGR

SEQ ID NO: 5393 - protein, 43 aa, Artificial Sequence
  Description of Artificial Sequence: Synthetic polypeptide
SGFTFSRYPMFWVRQAPGKGLEWVSYIVPSGGYTDYADSVKGR

SEQ ID NO: 5394 - protein, 43 aa, Artificial Sequence
  Description of Artificial Sequence: Synthetic polypeptide
SGFTFSRYPMIWVRQAPGKGLEWVSYIYPSGGGTYYADSVKGR

SEQ ID NO: 5395 - protein, 43 aa, Artificial Sequence
  Description of Artificial Sequence: Synthetic polypeptide
SGFTFSRYPMVWVRQAPGKGLEWVSYISPSGGYTGYADSVKGR

SEQ ID NO: 5396 - protein, 43 aa, Artificial Sequence
  Description of Artificial Sequence: Synthetic polypeptide
SGFTFSRYPMWWVRQAPGKGLEWVSSISSSGGGTYYADSVKGR

SEQ ID NO: 5397 - protein, 43 aa, Artificial Sequence
  Description of Artificial Sequence: Synthetic polypeptide
SGFTFSRYPMWWVRQAPGKGLEWVSSIYPSGGATFYADSVKGR

SEQ ID NO: 5398 - protein, 43 aa, Artificial Sequence
  Description of Artificial Sequence: Synthetic polypeptide
SGFTFSRYPMWWVRQAPGKGLEWVSVIYPSGGATYYADSVKGR

SEQ ID NO: 5399 - protein, 43 aa, Artificial Sequence
  Description of Artificial Sequence: Synthetic polypeptide
SGFTFSRYPMWWVRQAPGKGLEWVSVIYPSGGTTFYADSVKGR

SEQ ID NO: 5400 - protein, 43 aa, Artificial Sequence
  Description of Artificial Sequence: Synthetic polypeptide
SGFTFSRYPMWWVRQAPGKGLEWVSVIYSSGGYTGYADSVKGR

SEQ ID NO: 5401 - protein, 43 aa, Artificial Sequence
  Description of Artificial Sequence: Synthetic polypeptide
SGFTFSRYPMWWVRQAPGKGLEWVSYIGSSGGGTFYADSVKGR

SEQ ID NO: 5402 - protein, 43 aa, Artificial Sequence
  Description of Artificial Sequence: Synthetic polypeptide
SGFTFSRYPMWWVRQAPGKGLEWVSYISPSGGGTLYADSVKGR

SEQ ID NO: 5403 - protein, 43 aa, Artificial Sequence
  Description of Artificial Sequence: Synthetic polypeptide
SGFTFSRYPMWWVRQAPGKGLEWVSYISPSGGMTSYADSVKGR

SEQ ID NO: 5404 - protein, 43 aa, Artificial Sequence
  Description of Artificial Sequence: Synthetic polypeptide
SGFTFSRYPMWWVRQAPGKGLEWVSYISSSGGGTFYADSVKGR

SEQ ID NO: 5405 - protein, 43 aa, Artificial Sequence
  Description of Artificial Sequence: Synthetic polypeptide
SGFTFSRYPMWWVRQAPGKGLEWVSYISSSGGGTLYADSVKGR

SEQ ID NO: 5406 - protein, 43 aa, Artificial Sequence
  Description of Artificial Sequence: Synthetic polypeptide
SGFTFSRYPMWWVRQAPGKGLEWVSYIVPSGGATYYADSVKGR

SEQ ID NO: 5407 - protein, 43 aa, Artificial Sequence
  Description of Artificial Sequence: Synthetic polypeptide
SGFTFSRYPMWWVRQAPGKGLEWVSYIVPSGGFTDYADSVKGR

SEQ ID NO: 5408 - protein, 43 aa, Artificial Sequence
  Description of Artificial Sequence: Synthetic polypeptide
SGFTFSRYPMWWVRQAPGKGLEWVSYIVPSGGTTYYADSVKGR

SEQ ID NO: 5409 - protein, 43 aa, Artificial Sequence
  Description of Artificial Sequence: Synthetic polypeptide
SGFTFSRYPMWWVRQAPGKGLEWVSYIYPSGGATFYADSVKGR

SEQ ID NO: 5410 - protein, 43 aa, Artificial Sequence
  Description of Artificial Sequence: Synthetic polypeptide
SGFTFSRYPMWWVRQAPGKGLEWVSYIYSSGGKTFYADSVKGR

SEQ ID NO: 5411 - protein, 43 aa, Artificial Sequence
  Description of Artificial Sequence: Synthetic polypeptide
SGFTFSRYSMWWVRQAPGKGLEWVSSIYPSGGATFYADSVKGR

SEQ ID NO: 5412 - protein, 43 aa, Artificial Sequence
  Description of Artificial Sequence: Synthetic polypeptide
SGFTFSRYSMWWVRQAPGKGLEWVSVIYPSGGYTGYADSVKGR

SEQ ID NO: 5413 - protein, 43 aa, Artificial Sequence
  Description of Artificial Sequence: Synthetic polypeptide
SGFTFSRYWMWWVRQAPGKGLEWVSVIVPSGGATFYADSVKGR

SEQ ID NO: 5414 - protein, 43 aa, Artificial Sequence
  Description of Artificial Sequence: Synthetic polypeptide
SGFTFSRYYMMWVRQAPGKGLEWVSYISPSGGATYYADSVKGR

SEQ ID NO: 5415 - protein, 43 aa, Artificial Sequence
  Description of Artificial Sequence: Synthetic polypeptide
SGFTFSSYDMIWVRQAPGKGLEWVSWIGPSGGSTMYADSVKGR

SEQ ID NO: 5416 - protein, 43 aa, Artificial Sequence
  Description of Artificial Sequence: Synthetic polypeptide
SGFTFSSYDMWWVRQAPGKGLEWVSSISSSVGATYYADSVKGR

SEQ ID NO: 5417 - protein, 43 aa, Artificial Sequence
  Description of Artificial Sequence: Synthetic polypeptide
SGFTFSSYDMWWVRQAPGKGLEWVSVIGPSGGGTFYADSVKGR

SEQ ID NO: 5418 - protein, 43 aa, Artificial Sequence
  Description of Artificial Sequence: Synthetic polypeptide
SGFTFSSYDMWWVRQAPGKGLEWVSVISPSGGYTGYADSVKGR

SEQ ID NO: 5419 - protein, 43 aa, Artificial Sequence
  Description of Artificial Sequence: Synthetic polypeptide
SGFTFSSYDMWWVRQAPGKGLEWVSVIYPSGGRTYYADSVKGR

SEQ ID NO: 5420 - protein, 43 aa, Artificial Sequence
  Description of Artificial Sequence: Synthetic polypeptide
SGFTFSSYDMWWVRQAPGKGLEWVSVIYSSGGFTGYADSVKGR

SEQ ID NO: 5421 - protein, 43 aa, Artificial Sequence
  Description of Artificial Sequence: Synthetic polypeptide
SGFTFSSYDMWWVRQAPGKGLEWVSVIYSSGGTTFYADSVKGR

SEQ ID NO: 5422 - protein, 43 aa, Artificial Sequence
  Description of Artificial Sequence: Synthetic polypeptide
SGFTFSSYDMWWVRQAPGKGLEWVSVIYSSGGYTGYADSVKGR

SEQ ID NO: 5423 - protein, 43 aa, Artificial Sequence
  Description of Artificial Sequence: Synthetic polypeptide
SGFTFSSYEMWWVRQAPGKGLEWVSVIYSSGGATFYADSVKGR

SEQ ID NO: 5424 - protein, 43 aa, Artificial Sequence
  Description of Artificial Sequence: Synthetic polypeptide
SGFTFSSYEMWWVRQAPGKGLEWVSYISSSGGGTYYADSVKGR

SEQ ID NO: 5425 - protein, 43 aa, Artificial Sequence
  Description of Artificial Sequence: Synthetic polypeptide
SGFTFSSYMMIWVRQAPGKGLEWVSSISPSGGGTYYADSVKGR

SEQ ID NO: 5426 - protein, 43 aa, Artificial Sequence
  Description of Artificial Sequence: Synthetic polypeptide
SGFTFSSYMMIWVRQAPGKGLEWVSSISPSGGWTSYADSVKGR

SEQ ID NO: 5427 - protein, 43 aa, Artificial Sequence
  Description of Artificial Sequence: Synthetic polypeptide
SGFTFSSYMMIWVRQAPGKGLEWVSSIYPSGGYTSYADSVKGR

SEQ ID NO: 5428 - protein, 43 aa, Artificial Sequence
  Description of Artificial Sequence: Synthetic polypeptide
SGFTFSSYNMWWVRQAPGKGLEWVSSISPSGGGTYYADSVKGR

SEQ ID NO: 5429 - protein, 43 aa, Artificial Sequence
  Description of Artificial Sequence: Synthetic polypeptide
SGFTFSSYPMIWVRQAPGKGLEWVSYISSSGGFTDYADSVKGR

SEQ ID NO: 5430 - protein, 43 aa, Artificial Sequence
  Description of Artificial Sequence: Synthetic polypeptide
SGFTFSSYPMMWVRQAPGKGLEWVSYIYSSGGGTFYADSVKGR

SEQ ID NO: 5431 - protein, 43 aa, Artificial Sequence
  Description of Artificial Sequence: Synthetic polypeptide
SGFTFSSYPMWWVRQAPGKGLEWVSSISPSGGGTYYADSVKGR

SEQ ID NO: 5432 - protein, 42 aa, Artificial Sequence
  Description of Artificial Sequence: Synthetic polypeptide
SGFTFSSYPMWWVRQAPGKGLEWVSSISPSGMTYYADSVKGR

SEQ ID NO: 5433 - protein, 43 aa, Artificial Sequence
  Description of Artificial Sequence: Synthetic polypeptide
SGFTFSSYPMWWVRQAPGKGLEWVSSIYPSGGGTFYADSVKGR

SEQ ID NO: 5434 - protein, 43 aa, Artificial Sequence
  Description of Artificial Sequence: Synthetic polypeptide
SGFTFSSYPMWWVRQAPGKGLEWVSYISSSGGGTYYADSVKGR

SEQ ID NO: 5435 - protein, 43 aa, Artificial Sequence
  Description of Artificial Sequence: Synthetic polypeptide
SGFTFSSYPMWWVRQAPGKGLEWVSYIVPSGGATFYADSVKGR

SEQ ID NO: 5436 - protein, 43 aa, Artificial Sequence
  Description of Artificial Sequence: Synthetic polypeptide
SGFTFSSYPMWWVRQAPGKGLEWVSYIVPSGGSTLYADSVKGR

SEQ ID NO: 5437 - protein, 43 aa, Artificial Sequence
  Description of Artificial Sequence: Synthetic polypeptide
SGFTFSSYPMWWVRQAPGKGLEWVSYIVPSGGYTYYADSVKGR

SEQ ID NO: 5438 - protein, 43 aa, Artificial Sequence
  Description of Artificial Sequence: Synthetic polypeptide
SGFTFSSYQMWWVRQAPGKGLEWVSSIYPSGGATFYADSVKGR

SEQ ID NO: 5439 - protein, 43 aa, Artificial Sequence
  Description of Artificial Sequence: Synthetic polypeptide
SGFTFSSYSMWWVRQAPGKGLEWVSVIYSSGGYTGYADSVKGR

SEQ ID NO: 5440 - protein, 43 aa, Artificial Sequence
  Description of Artificial Sequence: Synthetic polypeptide
SGFTFSTYAMIWVRQAPGKGLEWVSYIGPSGGFTDYADSVKGR

SEQ ID NO: 5441 - protein, 43 aa, Artificial Sequence
  Description of Artificial Sequence: Synthetic polypeptide
SGFTFSTYAMWWVRQAPGKGLEWVSYISPSGGGTFYADSVKGR

SEQ ID NO: 5442 - protein, 43 aa, Artificial Sequence
  Description of Artificial Sequence: Synthetic polypeptide
SGFTFSTYDMFWVRQAPGKGLEWVSSISSSGGATFYADSVKGR

SEQ ID NO: 5443 - protein, 43 aa, Artificial Sequence
  Description of Artificial Sequence: Synthetic polypeptide
SGFTFSTYDMIWVRQAPGKGLEWVSYISPSGGYTGYADSVKGR

SEQ ID NO: 5444 - protein, 43 aa, Artificial Sequence
  Description of Artificial Sequence: Synthetic polypeptide
SGFTFSTYDMIWVRQAPGKGLEWVSYISSSGGFTDYADSVKGR

SEQ ID NO: 5445 - protein, 43 aa, Artificial Sequence
  Description of Artificial Sequence: Synthetic polypeptide
SGFTFSTYDMWWVRQAPGKGLEWVSVIYPSGGPTYYADSVKGR

SEQ ID NO: 5446 - protein, 43 aa, Artificial Sequence
  Description of Artificial Sequence: Synthetic polypeptide
SGFTFSTYDMWWVRQAPGKGLEWVSYISSSGGGTFYADSVKGR

SEQ ID NO: 5447 - protein, 43 aa, Artificial Sequence
  Description of Artificial Sequence: Synthetic polypeptide
SGFTFSTYEMWWVRQAPGKGLEWVSYISSSGGGTGYADSVKGR

SEQ ID NO: 5448 - protein, 43 aa, Artificial Sequence
  Description of Artificial Sequence: Synthetic polypeptide
SGFTFSTYPMFWVRQAPGKGLEWVSYISPSGGYTDYADSVKGR

SEQ ID NO: 5449 - protein, 43 aa, Artificial Sequence
  Description of Artificial Sequence: Synthetic polypeptide
SGFTFSTYPMIWVRQAPGKGLEWVSYIVPSGGYTGYADSVKGR

SEQ ID NO: 5450 - protein, 43 aa, Artificial Sequence
  Description of Artificial Sequence: Synthetic polypeptide
SGFTFSTYPMMWVRQAPGKGLEWVSYIYPSGGATFYADSVKGR

SEQ ID NO: 5451 - protein, 43 aa, Artificial Sequence
  Description of Artificial Sequence: Synthetic polypeptide
SGFTFSTYPMWWVRQAPGKGLEWVSSISPSGGATYYADSVKGR

SEQ ID NO: 5452 - protein, 43 aa, Artificial Sequence
  Description of Artificial Sequence: Synthetic polypeptide
SGFTFSTYPMWWVRQAPGKGLEWVSSIVPSGGATYYADSVKGR

SEQ ID NO: 5453 - protein, 43 aa, Artificial Sequence
  Description of Artificial Sequence: Synthetic polypeptide
SGFTFSTYPMWWVRQAPGKGLEWVSVIYSSGGYTGYADSVKGR

SEQ ID NO: 5454 - protein, 43 aa, Artificial Sequence
  Description of Artificial Sequence: Synthetic polypeptide
SGFTFSTYPMWWVRQAPGKGLEWVSYISPSGGATFYADSVKGR

SEQ ID NO: 5455 - protein, 43 aa, Artificial Sequence
  Description of Artificial Sequence: Synthetic polypeptide
SGFTFSTYPMWWVRQAPGKGLEWVSYISPSGGGTFYADSVKGR

SEQ ID NO: 5456 - protein, 43 aa, Artificial Sequence
  Description of Artificial Sequence: Synthetic polypeptide
SGFTFSTYPMWWVRQAPGKGLEWVSYIVPSGGYTDYADSVKGR

SEQ ID NO: 5457 - protein, 43 aa, Artificial Sequence
  Description of Artificial Sequence: Synthetic polypeptide
SGFTFSTYPMWWVRQAPGKGLEWVSYIYPSGGGTFYADSVKGR

SEQ ID NO: 5458 - protein, 42 aa, Artificial Sequence
  Description of Artificial Sequence: Synthetic polypeptide
SGFTFSTYQMWWVRQAPGKGLEWVSSIYSSGGTFYADSVKGR

SEQ ID NO: 5459 - protein, 43 aa, Artificial Sequence
  Description of Artificial Sequence: Synthetic polypeptide
SGFTFSTYSMIWVRQAPGKGLEWVSYISPSGGFTDYADSVKGR

SEQ ID NO: 5460 - protein, 43 aa, Artificial Sequence
  Description of Artificial Sequence: Synthetic polypeptide
SGFTFSVYDMIWVRQAPGKGLEWVSYIGPSGGMTLYADSVKGR

SEQ ID NO: 5461 - protein, 43 aa, Artificial Sequence
  Description of Artificial Sequence: Synthetic polypeptide
SGFTFSVYDMWWVRQAPGKGLEWVSVIYPSGGATYYADSVKGR

SEQ ID NO: 5462 - protein, 43 aa, Artificial Sequence
  Description of Artificial Sequence: Synthetic polypeptide
SGFTFSVYDMWWVRQAPGKGLEWVSVIYPSGGYTDYADSVKGR

SEQ ID NO: 5463 - protein, 43 aa, Artificial Sequence
  Description of Artificial Sequence: Synthetic polypeptide
SGFTFSVYDMWWVRQAPGKGLEWVSVIYSSGGATFYADSVKGR

SEQ ID NO: 5464 - protein, 43 aa, Artificial Sequence
  Description of Artificial Sequence: Synthetic polypeptide
SGFTFSVYDMWWVRQAPGKGLEWVSVIYSSGGPTFYADSVKGR

SEQ ID NO: 5465 - protein, 43 aa, Artificial Sequence
  Description of Artificial Sequence: Synthetic polypeptide
SGFTFSVYDMWWVRQAPGKGLEWVSYISPSGGFTDYADSVKGR

SEQ ID NO: 5466 - protein, 43 aa, Artificial Sequence
  Description of Artificial Sequence: Synthetic polypeptide
SGFTFSVYEMWWVRQAPGKGLEWVSYISPSGGGTFYADSVKGR

SEQ ID NO: 5467 - protein, 43 aa, Artificial Sequence
  Description of Artificial Sequence: Synthetic polypeptide
SGFTFSVYNMWWVRQAPGKGLEWVSSISPSGGGTFYADSVKGR

SEQ ID NO: 5468 - protein, 43 aa, Artificial Sequence
  Description of Artificial Sequence: Synthetic polypeptide
SGFTFSVYPMWWVRQAPGKGLEWVSSISPSGGATYYADSVKGR

SEQ ID NO: 5469 - protein, 43 aa, Artificial Sequence
  Description of Artificial Sequence: Synthetic polypeptide
SGFTFSVYPMWWVRQAPGKGLEWVSSISPSGGYTGYADSVKGR

SEQ ID NO: 5470 - protein, 42 aa, Artificial Sequence
  Description of Artificial Sequence: Synthetic polypeptide
SGFTFSVYPMWWVRQAPGKGLEWVSSISSGGATYYADSVKGR

SEQ ID NO: 5471 - protein, 43 aa, Artificial Sequence
  Description of Artificial Sequence: Synthetic polypeptide
SGFTFSVYPMWWVRQAPGKGLEWVSWISPSGGGTFYADSVKGR

SEQ ID NO: 5472 - protein, 43 aa, Artificial Sequence
  Description of Artificial Sequence: Synthetic polypeptide
SGFTFSVYPMWWVRQAPGKGLEWVSWISSSGGGTAYADSVKGR

SEQ ID NO: 5473 - protein, 43 aa, Artificial Sequence
  Description of Artificial Sequence: Synthetic polypeptide
SGFTFSVYPMWWVRQAPGKGLEWVSYIVPSGGATYYADSVKGR

SEQ ID NO: 5474 - protein, 43 aa, Artificial Sequence
  Description of Artificial Sequence: Synthetic polypeptide
SGFTFSVYPMWWVRQAPGKGLEWVSYIYPSGGATYYADSVKGR

SEQ ID NO: 5475 - protein, 43 aa, Artificial Sequence
  Description of Artificial Sequence: Synthetic polypeptide
SGFTFSVYQMWWVRQAPGKGLEWVSVIYPSGGTTFYADSVKGR

SEQ ID NO: 5476 - protein, 43 aa, Artificial Sequence
  Description of Artificial Sequence: Synthetic polypeptide
SGFTFSVYWMIWVRQAPGKGLEWVSYISPSGGGTFYADSVKGR

SEQ ID NO: 5477 - protein, 43 aa, Artificial Sequence
  Description of Artificial Sequence: Synthetic polypeptide
SGFTFSWYAMWWVRQAPGKGLEWVSSISPSGGGTYYADSVKGR

SEQ ID NO: 5478 - protein, 43 aa, Artificial Sequence
  Description of Artificial Sequence: Synthetic polypeptide
SGFTFSWYDMFWVRQAPGKGLEWVSSISPSGGATFYADSVKGR

SEQ ID NO: 5479 - protein, 43 aa, Artificial Sequence
  Description of Artificial Sequence: Synthetic polypeptide
SGFTFSWYDMWWVRQAPGKGLEWVSVIYPSGGATYYADSVKGR

SEQ ID NO: 5480 - protein, 43 aa, Artificial Sequence
  Description of Artificial Sequence: Synthetic polypeptide
SGFTFSWYDMWWVRQAPGKGLEWVSVIYPSGGFTDYADSVKGR

SEQ ID NO: 5481 - protein, 43 aa, Artificial Sequence
  Description of Artificial Sequence: Synthetic polypeptide
SGFTFSWYDMWWVRQAPGKGLEWVSVIYPSGGYTGYADSVKGR

SEQ ID NO: 5482 - protein, 43 aa, Artificial Sequence
  Description of Artificial Sequence: Synthetic polypeptide
SGFTFSWYDMWWVRQAPGKGLEWVSVIYSSGGATFYADSVKGR

SEQ ID NO: 5483 - protein, 43 aa, Artificial Sequence
  Description of Artificial Sequence: Synthetic polypeptide
SGFTFSWYDMWWVRQAPGKGLEWVSVIYSSGGPTFYADSVKGR

SEQ ID NO: 5484 - protein, 43 aa, Artificial Sequence
  Description of Artificial Sequence: Synthetic polypeptide
SGFTFSWYEMWWVRQAPGKGLEWVSWISPSGGGTQYADSVKGR

SEQ ID NO: 5485 - protein, 43 aa, Artificial Sequence
  Description of Artificial Sequence: Synthetic polypeptide
SGFTFSWYEMWWVRQAPGKGLEWVSYISPSGGGTYYADSVKGR

SEQ ID NO: 5486 - protein, 43 aa, Artificial Sequence
  Description of Artificial Sequence: Synthetic polypeptide
SGFTFSWYNMWWVRQAPGKGLEWVSVIYPSGGGTFYADSVKGR

SEQ ID NO: 5487 - protein, 43 aa, Artificial Sequence
  Description of Artificial Sequence: Synthetic polypeptide
SGFTFSWYNMWWVRQAPGKGLEWVSYIVSSGGFTDYADSVKGR

SEQ ID NO: 5488 - protein, 43 aa, Artificial Sequence
  Description of Artificial Sequence: Synthetic polypeptide
SGFTFSWYPMIWVRQAPGKGLEWVSYISSSGGYTSYADSVKGR

SEQ ID NO: 5489 - protein, 43 aa, Artificial Sequence
  Description of Artificial Sequence: Synthetic polypeptide
SGFTFSWYPMTWVRQAPGKGLEWVSYISPSGGYTGYADSVKGR

SEQ ID NO: 5490 - protein, 43 aa, Artificial Sequence
  Description of Artificial Sequence: Synthetic polypeptide
SGFTFSWYPMVWVRQAPGKGLEWVSYIYPSGGGTFYADSVKGR

SEQ ID NO: 5491 - protein, 43 aa, Artificial Sequence
  Description of Artificial Sequence: Synthetic polypeptide
SGFTFSWYPMWWVRQAPGKGLEWVSSISPSGGATYYADSVKGR

SEQ ID NO: 5492 - protein, 43 aa, Artificial Sequence
  Description of Artificial Sequence: Synthetic polypeptide
SGFTFSWYPMWWVRQAPGKGLEWVSSIVPSGGATYYADSVKGR

SEQ ID NO: 5493 - protein, 43 aa, Artificial Sequence
  Description of Artificial Sequence: Synthetic polypeptide
SGFTFSWYPMWWVRQAPGKGLEWVSVIYPSGGYTSYADSVKGR

SEQ ID NO: 5494 - protein, 43 aa, Artificial Sequence
  Description of Artificial Sequence: Synthetic polypeptide
SGFTFSWYPMWWVRQAPGKGLEWVSVIYSSGGATFYADSVKGR

SEQ ID NO: 5495 - protein, 43 aa, Artificial Sequence
  Description of Artificial Sequence: Synthetic polypeptide
SGFTFSWYPMWWVRQAPGKGLEWVSVIYSSGGYTGYADSVKGR

SEQ ID NO: 5496 - protein, 43 aa, Artificial Sequence
  Description of Artificial Sequence: Synthetic polypeptide
SGFTFSWYPMWWVRQAPGKGLEWVSYIVPSGGATFYADSVKGR

SEQ ID NO: 5497 - protein, 43 aa, Artificial Sequence
  Description of Artificial Sequence: Synthetic polypeptide
SGFTFSWYPMWWVRQAPGKGLEWVSYIVPSGGRTYYADSVKGR

SEQ ID NO: 5498 - protein, 43 aa, Artificial Sequence
  Description of Artificial Sequence: Synthetic polypeptide
SGFTFSWYSMWWVRQAPGKGLEWVSVIYPSGGGTFYADSVKGR

SEQ ID NO: 5499 - protein, 43 aa, Artificial Sequence
  Description of Artificial Sequence: Synthetic polypeptide
SGFTFSWYTMWWVRQAPGKGLEWVSSISPSGGGTYYADSVKGR

SEQ ID NO: 5500 - protein, 43 aa, Artificial Sequence
  Description of Artificial Sequence: Synthetic polypeptide
SGFTFSWYYMIWVRQAPGKGLEWVSYISPSGGGTYYADSVKGR

SEQ ID NO: 5501 - protein, 43 aa, Artificial Sequence
  Description of Artificial Sequence: Synthetic polypeptide
SGFTFSYYDMIWVRQAPGKGLEWVSWISPSGGLTMYADSVKGR

SEQ ID NO: 5502 - protein, 43 aa, Artificial Sequence
  Description of Artificial Sequence: Synthetic polypeptide
SGFTFSYYDMIWVRQAPGKGLEWVSYIVPSGGYTSYADSVKGR

SEQ ID NO: 5503 - protein, 43 aa, Artificial Sequence
  Description of Artificial Sequence: Synthetic polypeptide
SGFTFSYYDMVWVRQAPGKGLEWVSYISPSGGFTLYADSVKGR

SEQ ID NO: 5504 - protein, 43 aa, Artificial Sequence
  Description of Artificial Sequence: Synthetic polypeptide
SGFTFSYYDMWWVRQAPGKGLEWVSSISPSGGFTGYADSVKGR

SEQ ID NO: 5505 - protein, 43 aa, Artificial Sequence
  Description of Artificial Sequence: Synthetic polypeptide
SGFTFSYYDMWWVRQAPGKGLEWVSVISSSGGGTFYADSVKGR

SEQ ID NO: 5506 - protein, 43 aa, Artificial Sequence
  Description of Artificial Sequence: Synthetic polypeptide
SGFTFSYYDMWWVRQAPGKGLEWVSVIYPSGGTTFYADSVKGR

SEQ ID NO: 5507 - protein, 43 aa, Artificial Sequence
  Description of Artificial Sequence: Synthetic polypeptide
SGFTFSYYDMWWVRQAPGKGLEWVSVIYPSGGYTAYADSVKGR

SEQ ID NO: 5508 - protein, 43 aa, Artificial Sequence
  Description of Artificial Sequence: Synthetic polypeptide
SGFTFSYYDMWWVRQAPGKGLEWVSYISSSGGGTYYADSVKGR

SEQ ID NO: 5509 - protein, 43 aa, Artificial Sequence
  Description of Artificial Sequence: Synthetic polypeptide
SGFTFSYYEMWWVRQAPGKGLEWVSYISSSGGFTSYADSVKGR

SEQ ID NO: 5510 - protein, 43 aa, Artificial Sequence
  Description of Artificial Sequence: Synthetic polypeptide
SGFTFSYYGMWWVRQAPGKGLEWVSVISPSGGGTFYADSVKGR

SEQ ID NO: 5511 - protein, 43 aa, Artificial Sequence
  Description of Artificial Sequence: Synthetic polypeptide
SGFTFSYYMMIWVRQAPGKGLEWVSGIVSSGGFTMYADSVKGR

SEQ ID NO: 5512 - protein, 43 aa, Artificial Sequence
  Description of Artificial Sequence: Synthetic polypeptide
SGFTFSYYMMWWVRQAPGKGLEWVSSISSSGGGTFYADSVKGR

SEQ ID NO: 5513 - protein, 43 aa, Artificial Sequence
  Description of Artificial Sequence: Synthetic polypeptide
SGFTFSYYMMWWVRQAPGKGLEWVSSIYSSGGATFYADSVKGR

SEQ ID NO: 5514 - protein, 43 aa, Artificial Sequence
  Description of Artificial Sequence: Synthetic polypeptide
SGFTFSYYNMWWVRQAPGKGLEWVSSISPSGGGTYYADSVKGR

SEQ ID NO: 5515 - protein, 43 aa, Artificial Sequence
  Description of Artificial Sequence: Synthetic polypeptide
SGFTFSYYPMFWVRQAPGKGLEWVSYISPSGGWTDYADSVKGR

SEQ ID NO: 5516 - protein, 43 aa, Artificial Sequence
  Description of Artificial Sequence: Synthetic polypeptide
SGFTFSYYPMIWVRQAPGKGLEWVSWISPSGGGTQYADSVKGR

SEQ ID NO: 5517 - protein, 42 aa, Artificial Sequence
  Description of Artificial Sequence: Synthetic polypeptide
SGFTFSYYPMVWVRQAPGKGLEWVSYIWPSGGTYYADSVKGR

SEQ ID NO: 5518 - protein, 43 aa, Artificial Sequence
  Description of Artificial Sequence: Synthetic polypeptide
SGFTFSYYPMWWVRQAPGKGLEWVSSIVPSGGATFYADSVKGR

SEQ ID NO: 5519 - protein, 43 aa, Artificial Sequence
  Description of Artificial Sequence: Synthetic polypeptide
SGFTFSYYPMWWVRQAPGKGLEWVSVIYPSGGATFYADSVKGR

SEQ ID NO: 5520 - protein, 43 aa, Artificial Sequence
  Description of Artificial Sequence: Synthetic polypeptide
SGFTFSYYPMWWVRQAPGKGLEWVSYISSSGGGTHYADSVKGR

SEQ ID NO: 5521 - protein, 43 aa, Artificial Sequence
  Description of Artificial Sequence: Synthetic polypeptide
SGFTFSYYPMWWVRQAPGKGLEWVSYIVPSGGATFYADSVKGR

What is claimed is:

1. An isolated antibody that binds to human Matrix Metalloproteinase-9 (MMP-9) and human Matrix Metalloproteinase-2 (MMP-2), wherein the antibody comprises a heavy chain variable domain comprising a HC-CDR1 comprising the amino acid sequence of SEQ ID NO: 1289, a HC-CDR2 comprising the amino acid sequence of SEQ ID NO: 1290, a HC-CDR3 comprising the amino acid sequence of SEQ ID NO: 1291, and a light chain variable region comprising an LC-CDR1 comprising the amino acid sequence of SEQ ID NO: 1286, a LC-CDR2 comprising the amino acid sequence of SEQ ID NO: 1287, and a LC-CDR3 region comprising the amino acid sequence of SEQ ID NO: 1288.

2. An anti-MMP-9/MMP-2 antibody-drug conjugate, wherein the conjugate comprises the isolated antibody of claim 1 and a drug.

3. The conjugate of claim 2, wherein the drug is a cytotoxic or cytostatic agent.

4. A composition comprising the isolated antibody of claim 1 and a pharmaceutically acceptable carrier.

* * * * *